(12) United States Patent
Vishnudas et al.

(10) Patent No.: US 10,061,887 B2
(45) Date of Patent: *Aug. 28, 2018

(54) INTERROGATORY CELL-BASED ASSAYS AND USES THEREOF

(75) Inventors: Vivek K. Vishnudas, Bedford, MA (US); Rangaprasad Sarangarajan, Boylston, MA (US); Niven Rajin Narain, Cambridge, MA (US); Min Du, Acton, MA (US); Tony Walshe, Boston, MA (US)

(73) Assignee: Berg LLC, Framingham, MA (US)

( * ) Notice: Subject to any disclaimer, the term of this patent is extended or adjusted under 35 U.S.C. 154(b) by 809 days.

This patent is subject to a terminal disclaimer.

(21) Appl. No.: 13/607,587

(22) Filed: Sep. 7, 2012

(65) Prior Publication Data

US 2013/0259847 A1 Oct. 3, 2013

Related U.S. Application Data

(60) Provisional application No. 61/619,326, filed on Apr. 2, 2012, provisional application No. 61/620,305, filed on Apr. 4, 2012, provisional application No. 61/665,631, filed on Jun. 28, 2012, provisional application No. 61/668,617, filed on Jul. 6, 2012, provisional application No. 61/678,596, filed on Aug. 1, 2012, provisional application No. 61/678,590, filed on Aug. 1, 2012.

(51) Int. Cl.
| | |
|---|---|
| *G06F 19/10* | (2011.01) |
| *G06F 19/12* | (2011.01) |
| *C12Q 1/02* | (2006.01) |
| *G01N 33/50* | (2006.01) |
| *G01N 33/68* | (2006.01) |

(52) U.S. Cl.
CPC ............ *G06F 19/12* (2013.01); *C12Q 1/025* (2013.01); *G01N 33/5008* (2013.01); *G01N 33/68* (2013.01)

(58) Field of Classification Search
None
See application file for complete search history.

(56) References Cited

U.S. PATENT DOCUMENTS

| 8,000,949 | B2 | 8/2011 | Nikolskaya et al. |
|---|---|---|---|
| 2006/0019888 | A1 | 1/2006 | Zhou |
| 2007/0134734 | A1 | 6/2007 | Endo et al. |
| 2008/0208784 | A1 | 8/2008 | Hill et al. |
| 2008/0294403 | A1 | 11/2008 | Zhu et al. |
| 2010/0316629 | A1 | 12/2010 | Shaughnessy, Jr. et al. |
| 2011/0027291 | A1 | 2/2011 | Schoeberl et al. |
| 2011/0131027 | A1 | 6/2011 | Solomon |
| 2011/0229483 | A1 | 9/2011 | Griffioen et al. |
| 2012/0070849 | A1 | 3/2012 | Perez et al. |
| 2012/0258874 | A1 | 10/2012 | Narain et al. |

FOREIGN PATENT DOCUMENTS

| EP | 1887351 A1 | 2/2008 |
|---|---|---|
| EP | 2600154 A1 | 6/2013 |
| JP | 2005-6563 A | 1/2005 |
| WO | WO-02072871 A2 | 9/2002 |
| WO | 03/023573 A2 | 3/2003 |
| WO | WO-2005/024421 A1 | 3/2005 |
| WO | WO-2006/079092 A2 | 7/2006 |
| WO | WO-2008/060620 A2 | 5/2008 |

OTHER PUBLICATIONS

Choudhary and Mann, "Decoding signalling networks by mass spectrometry-based proteomics," *Nature Rev. Mol. Cell Biol.*, 11(6):427-439 (2010).
Davidson and Parkin, "Is Hyperglycemia a Causal Factor in Cardiovascular Disease?" *Diabetes Care*, 32(Suppl. 2):S331-S333 (2009).
De Jong, "Modeling and Simulation of Genetic Regulatory Systems: A Literature Review," *J. Computational Biol.*, 9(1):67-103 (2002).
El Samad et al., "Stochastic modelling of gene regulatory networks," *Intl. J. Robust Nonlinear Control*, 15:691-711 (2005).
Ferrara et al., "Genetic Networks of Liver Metabolism Revealed by Integration of Metabolic and Transcriptional Profiling," *PLoS Genetic*, 4(3):e1000034, pp. 1-13 (2008).
Grimaldi et al., "RegnANN: Reverse Engineering Gene Networks Using Artificial Neural Networks," PLoS One, 6(12):e28646, pp. 1-19 (2011).
High Performance Computing, "Case Study. Bringing the power of HPC to Drug Discovery and the Delivery of 'Smarter' Health Care," Council on Competitiveness, [retrieved on Jun. 11, 2013] url:<<http://www.compete.org/images/uploads/File/PDP/020Files/HPC_GNS.pdf>> (2010), pp. 1-10.
Imoto et al., "Computational Strategy for Discovering Druggable Gene Networks from Genome-Wide RNA Expression Profiles," Pacific Symposium on Biocomputing 2006, 11:559-571 (2006).
Li et al., "Large-scale dynamic gene regulatory network inference combining differential equation models with local dynamic Bayesian network analysis," *Bioinformatics*, 27(9):2686-2691 (2011).

(Continued)

*Primary Examiner* — Lori A. Clow
(74) *Attorney, Agent, or Firm* — McCarter & English, LLP; Elizabeth A. Hanley, Esq.; Jill Mello

(57) ABSTRACT

Described herein are methods for identifying a modulator of a biological system. Some methods include establishing a model for the biological system comprising cells, obtaining a first data set representing global proteomic in the cells, and obtaining a second data set representing one or more functional activities or cellular responses of the cells including global enzymatic activity and/or an effect of the global enzyme activity on the enzyme metabolites or substrates in the cells. The method also includes generating a consensus causal relationship network among the global proteomic changes and the one or more functional activities or cellular responses based solely on the first and second data sets using a programmed computing device, and identifying a causal relationship unique in the biological system from the consensus causal relationship network, wherein at least one enzyme associated with the unique causal relationship is identified as a modulator of the biological system.

27 Claims, 62 Drawing Sheets

Specification includes a Sequence Listing.

(56) References Cited

OTHER PUBLICATIONS

"New Company, Via Science, Created to Leverage REFS 'Big Data' Supercomputer Technology Across Multiple Industry Applications," PRNewswire, Nov. 2, 2010. [Retrieved on Jun. 11, 2013]: <<http://www.prnewswire.com/news-releases/new-company-via-science-created-to-leverage-refs-big-data-supercomputer-technology-across-mul>, pp. 1-3.
Sachs et al., "Causal Protein-Signaling Networks Derived from Multiparameter Single-Cell Data," *Science*, 308:523-529 (2005).
Shannon et al., "Cytoscape: A Software Environment for Integrated Models of Biomolecular Interaction Networks," *Genome Res.*, 13:2498-2504 (2003).
Smoot et al., "Cytoscape 2.8: new features for data integration and network visualization," *Bioinformatics*, 27(3):431-432 (2011) (advance access publication Dec. 10, 2010).
Tomshine and Kaznessis, "Optimization of a Stochastically Simulated Gene Network Model via Simulated Annealing," *Biophys. J.*, 91:3196-3205 (2006).
Valcarcel et al., "A Differential Network Approach to Exploring Differences between Biological States: An Application to Prediabetes," *PLoS ONE*, 6(9):e24702, pp. 1-9 (2011).
Wu et al, "Multiparameter metabolic analysis reveals a close link between attenuated mitochrondrial bioenergetic function and enhanced glycolysis dependency in human tumor cells," *Am. J. Physiol. Cell Physiol.*, 292:C125-C136 (2007).
Xing et al, "Causal Modeling Using Network Ensemble Simulations of Genetic and Gene Expression Data Predicts Genes Involved in Rheumatoid Arthritis," *PLoS Computational Biology*, 7(3):1-19 (2011).
Gill et al., "A statistical framework for differential network analysis from microarray data," BMC Bioinformatics 2010, 11:95, total 10 pages.
U.S. Appl. No. 13/411,460, US 2012-0258874 A1, Oct. 11, 2012.

Compare the unique edges of Normal in the normal vs. disease delta network with the unique edges of Disease T1 in the disease vs. disease T1 delta network. Edges in the intersection of normal and disease T1 are disease edges that were restored to normal when treated with T1.

Applying "Multi-Proteomics" techniques to elucidate enzyme/kinase activity.
Integration of multiple proteomics datasets generated from *in-vitro* model provides a unique system to understand causal relationship between enzymes/kinases and their metabolites/ substrates in the context of global changes in cellular proteome.

INTERROGATORY CELL-BASED ASSAYS AND USES THEREOF

RELATED APPLICATIONS

This application claims priority to Provisional Patent Application Ser. No. 61/619,326, filed on Apr. 2, 2012; Provisional Patent Application Ser. No. 61/668,617, filed on Jul. 6, 2012; Provisional Patent Application Ser. No. 61/620,305, filed on Apr. 4, 2012; Provisional Patent Application Ser. No. 61/665,631, filed on Jun. 28, 2012; Provisional Patent Application Ser. No. 61/678,596, filed on Aug. 1, 2012; and Provisional Patent Application Ser. No. 61/678,590, filed on Aug. 1, 2012, the entire contents of each of which are expressly incorporated herein by reference.

SEQUENCE LISTING

The instant application contains a Sequence Listing which has been submitted in ASCII format via EFS-Web and is hereby incorporated by reference in its entirety. Said ASCII copy, created on Sep. 27, 2012, is named 11999261.txt and is 653,823 bytes in size.

BACKGROUND OF THE INVENTION

New drug development has been enhanced greatly since the discovery of DNA in 1964 by James Watson and Francis Crick, pioneers of what we refer today as molecular biology. The tools and products of molecular biology allow for rapid, detailed, and precise measurement of gene regulation at both the DNA and RNA level. The next three decades following the paradigm-shifting discovery would see the genesis of knock-out animal models, key enzyme-linked reactions, and novel understanding of disease mechanisms and pathophysiology from the aforementioned platforms. In spring 2000, when Craig Ventor and Francis Collins announced the initial sequencing of the human genome, the scientific world entered a new wave of medicine.

The mapping of the genome immediately sparked hopes of, for example, being able to control disease even before it was initiated, of using gene therapy to reverse the degenerative brain processes that causes Alzheimer's or Parkinson's Disease, and of a construct that could be introduced to a tumor site and cause eradication of disease while restoring the normal tissue architecture and physiology. Others took controversial twists and proposed the notion of creating desired offspring with respect to eye or hair color, height, etc. Ten years later, however, we are still waiting with no particular path in sight for sustained success of gene therapy, or even elementary control of the genetic process.

Thus, one apparent reality is that genetics, at least independent of supporting constructs, does not drive the end-point of physiology. Indeed, many processes such as post-transcriptional modifications, mutations, single-nucleotide polymorphisms (SNP's), and translational modifications could alter the providence of a gene and/or its encoded complementary protein, and thereby contribute to the disease process.

SUMMARY OF THE INVENTION

The information age and creation of the internet has allowed for an information overload, while also facilitating international collaboration and critique. Ironically, the aforementioned realities may also be the cause of the scientific community overlooking a few simple points, including that communication of signal cascades and cross-talk within and between cells and/or tissues allows for homeostasis and messaging for corrective mechanisms to occur when something goes awry.

A case on point relates to cardiovascular disease (CVD), which remains the leading cause of death in the United States and much of the developed world, accounting for 1 of every 2.8 deaths in the U.S. alone. In addition, CVD serves as an underlying pathology that contributes to associated complications such as Chronic Kidney Disease (~19 million US cases), chronic fatigue syndrome, and a key factor in metabolic syndrome. Significant advances in technology related to diagnostics, minimally invasive surgical techniques, drug eluting stents and effective clinical surveillance has contributed to an unparalleled period of growth in the field of interventional cardiology, and has allowed for more effective management of CVD. However, disease etiology related to CVD and associated co-morbidities such as diabetes and peripheral vascular disease are yet to be fully elucidated.

New approaches to explore the mechanisms and pathways involved in a biological process, such as the etiology of disease conditions (e.g., CVD), and to identify key regulatory pathways and/or target molecules (e.g., "drugable targets") and/or markers for better disease diagnosis, management, and/or treatment, are still lacking.

The invention described herein is based, at least in part, on a novel, collaborative utilization of network biology, genomic, proteomic, metabolomic, transcriptomic, and bioinformatics tools and methodologies, which, when combined, may be used to study any biological system of interest, such as selected disease conditions including cancer, diabetes, obesity, cardiovascular disease, and angiogenesis, using a systems biology approach. In a first step, cellular modeling systems are developed to probe various biological systems, such as a disease process, comprising disease-related cells subjected to various disease-relevant environment stimuli (e.g., hyperglycemia, hypoxia, immuno-stress, and lipid peroxidation, cell density, angiogenic agonists and antagonists). In some embodiments, the cellular modeling system involves cellular cross-talk mechanisms between various interacting cell types (such as aortic smooth muscle cells (HASMC), proximal tubule kidney cells (HK-2), aortic endothelial cells (HAEC), and dermal fibroblasts (HDFa)). High throughput biological readouts from the cell model system are obtained by using a combination of techniques, including, for example, cutting edge mass spectrometry (LC/MSMS), flow cytometry, cell-based assays, and functional assays. The high throughput biological readouts are then subjected to a bioinformatic analysis to study congruent data trends by in vitro, in vivo, and in silico modeling. The resulting matrices allow for cross-related data mining where linear and non-linear regression analysis were developed to reach conclusive pressure points (or "hubs"). These "hubs," as presented herein, are candidates for drug discovery. In particular, these hubs represent potential drug targets and/or disease markers.

The molecular signatures of the differentials allow for insight into the mechanisms that dictate the alterations in the tissue microenvironment that lead to disease onset and progression. Taken together, the combination of the aforementioned technology platforms with strategic cellular modeling allows for robust intelligence that can be employed to further establish disease understanding while creating biomarker libraries and drug candidates that may clinically augment standard of care.

Moreover, this approach is not only useful for disease diagnosis or intervention, but also has general applicability to virtually all pathological or non-pathological conditions in biological systems, such as biological systems where two or more cell systems interact. For example, this approach is useful for obtaining insight into the mechanisms associated with or causal for drug toxicity. The invention therefore provides a framework for an interrogative biological assessment that can be generally applied in a broad spectrum of settings.

A significant feature of the platform of the invention is that the AI-based system is based on the data sets obtained from the cell model system, without resorting to or taking into consideration any existing knowledge in the art, such as known biological relationships (i.e., no data points are artificial), concerning the biological process. Accordingly, the resulting statistical models generated from the platform are unbiased. Another significant feature of the platform of the invention and its components, e.g., the cell model systems and data sets obtained therefrom, is that it allows for continual building on the cell models over time (e.g., by the introduction of new cells and/or conditions), such that an initial, "first generation" consensus causal relationship network generated from a cell model for a biological system or process can evolve along with the evolution of the cell model itself to a multiple generation causal relationship network (and delta or delta-delta networks obtained therefrom). In this way, both the cell models, the data sets from the cell models, and the causal relationship networks generated from the cell models by using the Platform Technology methods can constantly evolve and build upon previous knowledge obtained from the Platform Technology.

The invention provides methods for identifying a modulator of a biological system, the methods comprising:

establishing a model for the biological system, using cells associated with the biological system, to represents a characteristic aspect of the biological system;

obtaining a first data set from the model, wherein the first data set represents global proteomic changes in the cells associated with the biological system;

obtaining a second data set from the model, wherein the second data set represents one or more functional activities or cellular responses of the cells associated with the biological system, wherein said one or more functional activities or cellular responses of the cells comprises global enzymatic activity and/or an effect of the global enzyme activity on the enzyme metabolites or substrates in the cells associated with the biological system;

generating a consensus causal relationship network among the global proteomic changes and the one or more functional activities or cellular responses based solely on the first and second data sets using a programmed computing device, wherein the generation of the consensus causal relationship network is not based on any known biological relationships other than the first and second data sets; and identifying, from the consensus causal relationship network, a causal relationship unique in the biological system, wherein at least one enzyme associated with the unique causal relationship is identified as a modulator of the biological system.

In certain embodiments, the first data set is a single proteomic data set. In certain embodiments, the second data set represents a single functional activity or cellular response of the cells associated with the biological system. In certain embodiments, the first data set further represents lipidomic data characterizing the cells associated with the biological system. In certain embodiments, the consensus causal relationship network is generated among the global proteomic changes, lipidomic data, and the one or more functional activities or cellular responses of the cells, wherein said one or more functional activities or cellular responses of the cells comprises global enzymatic activity.

In certain embodiments, the first data set further represents one or more of lipidomic, metabolomic, transcriptomic, genomic and SNP data characterizing the cells associated with the biological system. In certain embodiments, the first data set further represents two or more of lipidomic, metabolomic, transcriptomic, genomic and SNP data characterizing the cells associated with the biological system. In certain embodiments, the consensus causal relationship network is generated among the global proteomic changes, the one or more of lipidomic, metabolomic, transcriptomic, genomic, and SNP data, and the one or more functional activities or cellular responses of the cells, wherein said one or more functional activities or cellular responses of the cells comprises global enzymatic activity and/or the effect of the global enzymatic activity on at least one enzyme metabolite or substrate.

In certain embodiments, the global enzyme activity comprises global kinase activity. In certain embodiments, the effect of the global enzyme activity on the enzyme metabolites or substrates comprises the phospho proteome of the cells.

In certain embodiments, the second data set representing one or more functional activities or cellular responses of the cell further comprises one or more of bioenergetics, cell proliferation, apoptosis, organellar function, cell migration, tube formation, chemotaxis, extracellular matrix degradation, sprouting, and a genotype-phenotype associate actualized by functional models selected from ATP, ROS, OXPHOS, and Seahorse assays. In certain embodiments, the consensus causal relationship network is generated among the global proteomic changes, the one or more of lipidomic, metabolomic, transcriptomic, genomic, and SNP data, and the one or more functional activities or cellular responses of the cells, wherein said one or more functional activities or cellular responses of the cells comprises global enzymatic activity and/or the effect of the global enzymatic activity on at least one enzyme metabolite or substrate and further comprises one or more of bioenergetics, cell proliferation, apoptosis, organellar function, cell migration, tube formation, chemotaxis, extracellular matrix degradation, sprouting, and a genotype-phenotype associate actualized by functional models selected from ATP, ROS, OXPHOS, and Seahorse assays.

In certain embodiments of the invention, the model of the biological system comprises an in vitro culture of cells associated with the biological system. In certain embodiments of the invention, the model of the biological system optionally further comprising a matching in vitro culture of control cells.

In certain embodiments of the invention, the model of the biological system the in vitro culture of the cells is subject to an environmental perturbation, and the in vitro culture of the matching control cells is identical cells not subject to the environmental perturbation. In certain embodiments, the model of the biological system the environmental perturbation comprises one or more of contact with a bioactive agent, a change in culture condition, introduction of a genetic modification/mutation, and introduction of a vehicle that causes a genetic modification/mutation. In certain embodiments, the model of the biological system the environmental perturbation comprises contacting the cells with an enzymatic activity inhibitor. In certain embodiments, in the model of the biological system the enzymatic activity inhibitor is a kinase inhibitor. In certain embodiments, the environmental perturbation comprises contacting the cells with CoQ10. In certain embodiments, the environmental perturbation comprises further contacting the cells with CoQ10.

In certain embodiments of the invention, the generating step is carried out by an artificial intelligence (AI)-based informatics platform. In certain embodiments, the AI-based informatics platform receives all data input from the first and second data sets without applying a statistical cut-off point. In certain embodiments of the invention, the consensus causal relationship network established in the generating step is further refined to a simulation causal relationship network, before the identifying step, by in silico simulation based on input data, to provide a confidence level of prediction for one or more causal relationships within the consensus causal relationship network.

In certain embodiments of the invention, the unique causal relationship is identified as part of a differential causal relationship network that is uniquely present in cells associated with the biological system, and absent in the matching control cells. In certain embodiments, the unique causal relationship is identified as part of a differential causal relationship network that is uniquely present in cells associated with the biological system, and absent in the matching control cells.

In certain embodiments of the invention, the unique causal relationship identified is a relationship between at least one pair selected from the group consisting of expression of a gene and level of a lipid; expression of a gene and level of a transcript; expression of a gene and level of a metabolite; expression of a first gene and expression of a second gene; expression of a gene and presence of a SNP; expression of a gene and a functional activity; level of a lipid and level of a transcript; level of a lipid and level of a metabolite; level of a first lipid and level of a second lipid; level of a lipid and presence of a SNP; level of a lipid and a functional activity; level of a first transcript and level of a second transcript; level of a transcript and level of a metabolite; level of a transcript and presence of a SNP; level of a first transcript and level of a functional activity; level of a first metabolite and level of a second metabolite; level of a metabolite and presence of a SNP; level of a metabolite and a functional activity; presence of a first SNP and presence of a second SNP; and presence of a SNP and a functional activity. In certain embodiments, the unique causal relationship identified is a relationship between at least a level of a lipid, expression of a gene, and one or more functional activities wherein the functional activity is a kinase activity.

The invention provides methods for identifying a modulator of a disease process, the method comprising:
  establishing a model for the disease process, using disease related cells, to represents a characteristic aspect of the disease process;
  obtaining a first data set from the model, wherein the first data set represents global proteomic changes in the disease related cells;
  obtaining a second data set from the model, wherein the second data set represents one or more functional activities or cellular responses of the cells associated with the biological system, wherein said one or more functional activities or cellular responses of the cells comprises global enzyme activity and/or an effect of the global enzyme activity on the enzyme metabolites or substrates in the disease related cells;
  generating a consensus causal relationship network among the global proteomic changes and the one or more functional activities or cellular responses of the cells based solely on the first and second data sets using a programmed computing device, wherein the generation of the consensus causal relationship network is not based on any known biological relationships other than the first and second data sets; and
  identifying, from the consensus causal relationship network, a causal relationship unique in the disease process, wherein at least one enzyme associated with the unique causal relationship is identified as a modulator of the disease process.

In certain embodiments, the first data set is a single proteomic data set. In certain embodiments, the second data set represents a single functional activity or cellular response of the cells associated with the biological system. In certain embodiments, the first data set further represents lipidomic data characterizing the cells associated with the biological system. In certain embodiments, the consensus causal relationship network is generated among the global proteomic changes, lipidomic data, and the one or more functional activities or cellular responses of the cells, wherein said one or more functional activities or cellular responses of the cells comprises global enzymatic activity. In certain embodiments, the first data set further represents one or more of lipidomic, metabolomic, transcriptomic, genomic and SNP data characterizing the cells associated with the biological system. In certain embodiments, the first data set further represents two or more of lipidomic, metabolomic, transcriptomic, genomic and SNP data characterizing the cells associated with the biological system. In certain embodiments, the consensus causal relationship network is generated among the global proteomic changes, the one or more of lipidomic, metabolomic, transcriptomic, genomic and SNP data, and the one or more functional activities or cellular responses of the cells, wherein said one or more functional activities or cellular responses of the cells comprises global enzymatic activity and/or the effect of the global enzymatic activity on at least one enzyme metabolite or substrate.

In certain embodiments of the invention, the global enzyme activity comprises global kinase activity, and wherein the effect of the global enzyme activity on the enzyme metabolites or substrates comprises the phospho proteome of the cells. In certain embodiments, the second data set representing one or more functional activities or cellular responses of the cell further comprises one or more of bioenergetics, cell proliferation, apoptosis, organellar function, cell migration, tube formation, chemotaxis, extracellular matrix degradation, sprouting, and a genotype-phenotype associate actualized by functional models selected from ATP, ROS, OXPHOS, and Seahorse assays. In certain embodiments, the consensus causal relationship network is generated among the global proteomic changes, the one or more of lipidomic, metabolomic, transcriptomic, genomic and SNP data, and the one or more functional activities or cellular responses of the cells, wherein said one or more functional activities or cellular responses of the cells comprises one or more of bioenergetics, cell proliferation, apoptosis, organellar function, cell migration, tube formation, chemotaxis, extracellular matrix degradation, sprouting, and a genotype-phenotype associate actualized by functional models selected from ATP, ROS, OXPHOS, and Seahorse assays.

In certain embodiments of the invention, the disease process is cancer, diabetes, obesity, cardiovascular disease, age related macular degeneration, diabetic retinopathy, inflammatory disease. In certain embodiments, the disease process comprises angiogenesis. In certain embodiments, the disease process comprises hepatocellular carcinoma, lung cancer, breast cancer, prostate cancer, melanoma, carcinoma, sarcoma, lymphoma, leukemia, squamous cell carcinoma, colorectal cancer, pancreatic cancer, thyroid cancer, endometrial cancer, bladder cancer, kidney cancer, a solid tumor, leukemia, non-Hodgkin lymphoma, or a drug-resistant cancer.

In certain embodiments of the invention, the disease model comprises an in vitro culture of disease cells, optionally further comprising a matching in vitro culture of control or normal cells. In certain embodiments, the in vitro culture of the disease cells is subject to an environmental perturbation, and the in vitro culture of the matching control cells is identical disease cells not subject to the environmental perturbation. In certain embodiments, the environmental perturbation comprises one or more of contact with a bioactive agent, a change in culture condition, introduction of a genetic modification/mutation, and introduction of a vehicle that causes a genetic modification/mutation. In certain embodiments, the environmental perturbation comprises contacting the cells with an enzymatic activity inhibitor. In certain embodiments, the enzymatic activity inhibitor is a kinase inhibitor. In certain embodiments, the environmental perturbation further comprises contacting the cells with CoQ10. In certain embodiments, the environmental perturbation comprises contacting the cells with CoQ10.

In certain embodiments, the characteristic aspect of the disease process comprises a hypoxia condition, a hyperglycemic condition, a lactic acid rich culture condition, or combinations thereof. In certain embodiments, the generating step is carried out by an artificial intelligence (AI)-based informatics platform. In certain embodiments, the AI-based informatics platform receives all data input from the first and second data sets without applying a statistical cut-off point.

In certain embodiments, the consensus causal relationship network established in the generating step is further refined to a simulation causal relationship network, before the identifying step, by in silico simulation based on input data, to provide a confidence level of prediction for one or more causal relationships within the consensus causal relationship network. In certain embodiments, the unique causal relationship is identified as part of a differential causal relationship network that is uniquely present in model of disease cells, and absent in the matching control cells. In certain embodiments, the unique causal relationship is identified as part of a differential causal relationship network that is uniquely present in cells subject to environmental perturbation, and absent in the matching control cells.

The invention provides methods for identifying modulators of a biological system, the methods comprising:
  establishing a model for the biological system, using cells associated with the biological system, to represents a characteristic aspect of the biological system;
    obtaining a first data set from the model, wherein the first data set represents global proteomic changes in the cells and one or more of lipidomic, metabolomic, transcriptomic, genomic, and SNP data characterizing the cells associated with the biological system;
    obtaining a second data set from the model, wherein the second data set represents one or more functional activities or cellular responses of the cells associated with the biological system, wherein said one or more functional activities or cellular responses of the cells comprises global kinase activity and an effect of the global kinase activity on the kinase metabolites or substrates in the cells associated with the biological system;
    generating a consensus causal relationship network among the global proteomic changes, the one or more of lipidomic, metabolomic, transcriptomic, genomic, and SNP data, and the one or more functional activities or cellular responses based solely on the first and second data sets using a programmed computing device, wherein the generation of the consensus causal relationship network is not based on any known biological relationships other than the first and second data sets; and
    identifying, from the consensus causal relationship network, a causal relationship unique in the biological system, wherein at least one kinase associated with the unique causal relationship is identified as a modulator of the biological system.

The invention provides methods for treating, alleviating a symptom of, inhibiting progression of, preventing, diagnosing, or prognosing a disease in a mammalian subject, the methods comprising:
  administering to the mammal in need thereof a therapeutically effective amount of a pharmaceutical composition comprising a biologically active substance that affects the modulator identified by any of the methods provided herein, thereby treating, alleviating a symptom of, inhibiting progression of, preventing, diagnosing, or prognosing the disease.

The invention provides methods of diagnosing or prognosing a disease in a mammalian subject, the method comprising:
  determining an expression or activity level, in a biological sample obtained from the subject, of one or more modulators identified by any of the methods provided herein; and
  comparing the level in the subject with the level of expression or activity of the one or more modulators in a control sample,
  wherein a difference between the level in the subject and the level of expression or activity of the one or more modulators in the control sample is an indication that the subject is afflicted with a disease, or predisposed to developing a disease, or responding favorably to a therapy for a disease, thereby diagnosing or prognosing the disease in the mammalian subject.

The invention provides methods of identifying a therapeutic compound for treating, alleviating a symptom of, inhibiting progression of, or preventing a disease in a mammalian subject, the methods comprising:
  contacting a biological sample from a mammalian subject with a test compound;
  determining the level of expression, in the biological sample, of one or more modulators identified by any of the methods provided herein;
  comparing the level of expression of the one or more modulators in the biological sample with a control sample not contacted by the test compound; and
  selecting the test compound that modulates the level of expression of the one or more modulators in the biological sample,
  thereby identifying a therapeutic compound for treating, alleviating a symptom of, inhibiting progression of, or preventing a disease in a mammalian subject.

The invention provides methods for treating, alleviating a symptom of, inhibiting progression of, or preventing a disease in a mammalian subject, the methods comprising:
  administering to the mammal in need thereof a therapeutically effective amount of a pharmaceutical composition comprising the therapeutic compound identified using any of the methods provided herein, thereby treating, alleviating a symptom of, inhibiting progression of, or preventing the disease.

The invention provides methods for treating, alleviating a symptom of, inhibiting progression of, or preventing a disease in a mammalian subject, the methods comprising:

administering to the mammal in need thereof a therapeutically effective amount of a pharmaceutical composition comprising a biologically active substance that affects expression or activity of any one or more of TCOF1, TOP2A, CAMK2A, CDK1, CLTCL1, EIF4G1, ENO1, EBL, GSK3B, HDLBP, HIST1H2BA, HMGB2, HNRNPK, HNRPDL, HSPA9, MAP2K2, LDHA, MAP4, MAPK1, MARCKS, NME1, NME2, PGK1, PGK2, RAB7A, RPL17, RPL28, RPS5, RPS6, SLTM, TMED4, TNRCBA, TUBB, and UBE21, thereby treating, alleviating a symptom of, inhibiting progression of, or preventing the disease. In certain embodiments, the disease is hepatocellular carcinoma.

The invention provides methods of diagnosing or prognosing diseases in a mammalian subject, the methods comprising:

determining an expression or activity level, in a biological sample obtained from the subject, of any one or more proteins of TCOF1, TOP2A, CAMK2A, CDK1, CLTCL1, EIF4G1, ENO1, FBL, GSK3B, HDLBP, HIST1H2BA, HMGB2, HNRNPK, HNRPDL, HSPA9, MAP2K2, LDHA, MAP4, MAPK1, MARCKS, NME1, NME2, PGK1, PGK2, RAB7A, RPL17, RPL28, RPS5, RPS6, SLTM, TMED4, TNRCBA, TUBB, and UBE21; and comparing the level in the subject with the level of expression or activity of the one or more proteins in a control sample, wherein a difference between the level in the subject and the level of expression or activity of the one or more proteins in the control sample is an indication that the subject is afflicted with a disease, or predisposed to developing a disease, or responding favorably to a therapy for a disease, thereby diagnosing or prognosing the disease in the mammalian subject. In certain embodiments, the disease is hepatocellular carcinoma.

The invention provides methods of identifying therapeutic compounds for treating, alleviating a symptom of, inhibiting progression of, or preventing a diseases in a mammalian subject, the methods comprising:

contacting a biological sample from a mammalian subject with a test compound;

determining the level of expression, in the biological sample, of any one or more proteins of TCOF1, TOP2A, CAMK2A, CDK1, CLTCL1, EIF4G1, ENO1, FBL, GSK3B, HDLBP, HIST1H2BA, HMGB2, HNRNPK, HNRPDL, HSPA9, MAP2K2, LDHA, MAP4, MAPK1, MARCKS, NME1, NME2, PGK1, PGK2, RAB7A, RPL17, RPL28, RPS5, RPS6, SLTM, TMED4, TNRCBA, TUBB, and UBE21;

comparing the level of expression of the one or more proteins in the biological sample with a control sample not contacted by the test compound; and selecting the test compound that modulates the level of expression of the one or more proteins in the biological sample, thereby identifying a therapeutic compound for treating, alleviating a symptom of, inhibiting progression of, or preventing a disease in a mammalian subject. In certain embodiments, the disease is hepatocellular carcinoma.

The invention provides methods for treating, alleviating a symptom of, inhibiting progression of, or preventing a diseases in a mammalian subject, the methods comprising:

administering to the mammal in need thereof a therapeutically effective amount of a pharmaceutical composition comprising the therapeutic compound identified by any of the methods provided herein, thereby treating, alleviating a symptom of, inhibiting progression of, or preventing the disease.

The invention provides methods for identifying a modulator of angiogenesis, said methods comprising:

(1) establishing a model for angiogenesis, using cells associated with angiogenesis, to represents a characteristic aspect of angiogenesis;

(2) obtaining a first data set from the model for angiogenesis, wherein the first data set represents one or more of genomic data, lipidomic data, proteomic data, metabolomic data, transcriptomic data, and single nucleotide polymorphism (SNP) data characterizing the cells associated with angiogenesis;

(3) obtaining a second data set from the model for angiogenesis, wherein the second data set represents one or more functional activities or a cellular responses of the cells associated with angiogenesis;

(4) generating a consensus causal relationship network among the one or more of genomic data, lipidomic data, proteomic data, metabolic data, transcriptomic data, and single nucleotide polymorphism (SNP) data characterizing the cells associated with angiogenesis, and the one or more functional activities or cellular responses of the cells associated with angiogenesis based solely on the first data set and the second data set using a programmed computing device, wherein the generation of the consensus causal relationship network is not based on any known biological relationships other than the first data set and the second data set;

(5) identifying, from the consensus causal relationship network, a causal relationship unique in angiogenesis, wherein a gene, lipid, protein, metabolite, transcript, or SNP associated with the unique causal relationship is identified as a modulator of angiogenesis.

The invention provides methods for identifying a modulator of angiogenesis, said methods comprising:

(1) establishing a model for angiogenesis, using cells associated with angiogenesis, to represents a characteristic aspect of angiogenesis;

(2) obtaining a first data set from the model for angiogenesis, wherein the first data set represents lipidomic data;

(3) obtaining a second data set from the model for angiogenesis, wherein the second data set represents one or more functional activities or a cellular responses of the cells associated with angiogenesis;

(4) generating a consensus causal relationship network among the lipidomics data and the functional activity or cellular response based solely on the first data set and the second data set using a programmed computing device, wherein the generation of the consensus causal relationship network is not based on any known biological relationships other than the first data set and the second data set;

(5) identifying, from the consensus causal relationship network, a causal relationship unique in angiogenesis, wherein a lipid associated with the unique causal relationship is identified as a modulator of angiogenesis.

In certain embodiments, the second data set representing one or more functional activities or cellular responses of the cells associated with angiogenesis comprises global enzymatic activity and an effect of the global enzymatic activity on the enzyme metabolites or substrates in the cells associated with angiogenesis.

The invention provides methods for identifying modulators of angiogenesis, said methods comprising:

(1) establishing a model for angiogenesis, using cells associated with angiogenesis, to represents a characteristic aspect of angiogenesis;

(2) obtaining a first data set from the model for angiogenesis, wherein the first data set represents one or more of genomic data, lipidomic data, proteomic data, metabolic data, transcriptomic data, and single nucleotide polymorphism (SNP) data characterizing the cells associated with angiogenesis;

(3) obtaining a second data set from the model for angiogenesis, wherein the second data set represents one or more functional activities or cellular responses kinase activity of the cells associated with angiogenesis, wherein the one or more functional activities or cellular responses comprises global enzymatic activity and/or an effect of the global enzymatic activity on the enzyme metabolites or substrates in the cells associated with angiogenesis;

(4) generating a consensus causal relationship network among the one or more of genomic data, lipidomic data, proteomic data, metabolic data, transcriptomic data, and single nucleotide polymorphism (SNP) data characterizing the cells associated with angiogenesis and the one or more functional activities or cellular responses of the cells associated with angiogenesis based solely on the first data set and the second data set using a programmed computing device, wherein the generation of the consensus causal relationship network is not based on any known biological relationships other than the first data set and the second data set;

(5) identifying, from the consensus causal relationship network, a causal relationship unique in angiogenesis, wherein an enzyme associated with the unique causal relationship is identified as a modulator of angiogenesis.

In certain embodiments of the invention, the global enzyme activity comprises global kinase activity and an effect of the global enzymatic activity on the enzyme metabolites or substrates in the cells associated with angiogenesis comprises the phosphoproteome of the cell. In certain embodiments, the global enzyme activity comprises global protease activity.

In certain embodiments of the invention, the modulator stimulates or promotes angiogenesis. In certain embodiments of the invention, the modulator inhibits angiogenesis.

In certain embodiments, the model for angiogenesis comprising cells associated with angiogenesis is selected from the group consisting of an in vitro cell culture angiogenesis model, rat aorta microvessel model, newborn mouse retina model, chick chorioallantoic membrane (CAM) model, corneal angiogenic growth factor pocket model, subcutaneous sponge angiogenic growth factor implantation model, MATRIGEL® angiogenic growth factor implantation model, and tumor implanation model; and wherein the model of angiogenesis optionally further comprises a matching control model of angiogenesis comprising control cells. In certain embodiments, the in vitro culture angiogenesis model is selected from the group consisting of MATRIGEL® tube formation assay, migration assay, Boyden chamber assay, scratch assay.

In certain embodiments, the cells associated with angiogenesis in the in vitro culture model are human endothelial vessel cells (HUVEC). In certain embodiments, the angiogenic growth factor in the corneal angiogenic growth factor pocket model, subcutaneous sponge angiogenic growth factor implantation model, or MATRIGEL® angiogenic growth factor implantation model is selected from the group consisting of FGF-2 and VEGF.

In certain embodiments of the invention, the cells in the model of angiogenesis are subject to an environmental perturbation, and the cells in the matching model of angiogenesis are an identical cells not subject to the environmental perturbation. In certain embodiments, the environmental perturbation comprises one or more of a contact with an agent, a change in culture condition, an introduced genetic modification or mutation, a vehicle that causes a genetic modification or mutation, and induction of ischemia.

In certain embodiments, the agent is a pro-angiogenic agent or an anti-angiogenic agent. In certain embodiments, the pro-angiogenic agent is selected from the group consisting of FGF-2 and VEGF. In certain embodiments, the anti-angiogenic agent is selected from the group consisting of VEGF inhibitors, integrin antagonists, angiostatin, endostatin, tumstatin, Avastin, sorafenib, sunitinib, pazopanib, and everolimus, soluble VEGF-receptor, angiopoietin 2, thrombospondinl, thrombospondin 2, vasostatin, calreticulin, prothrombin (kringle domain-2), antithrombin III fragment, vascular endothelial growth inhibitor (VEGI), Secreted Protein Acidic and Rich in Cysteine (SPARC) and a SPARC peptide corresponding to the follistatin domain of the protein (FS-E), and coenzyme Q10.

In any of the embodiments, the agent is an enzymatic activity inhibitor. In any of the embodiments, the agent is a kinase activity inhibitor.

In any of the embodiments of the invention, the first data set comprises protein and/or mRNA expression levels of to plurality of genes in the genomic data set. In certain embodiments of the invention, the first data set comprises two or more of genomic data, lipidomic data, proteomic data, metabolic data, transcriptomic data, and single nucleotide polymorphism (SNP) data. In certain embodiments of the invention, the first data set comprises three or more of genomic data, lipidomic data, proteomic data, metabolic data, transcriptomic data, and single nucleotide polymorphism (SNP) data.

In any of the embodiments of the invention, the second data set representing one or more functional activities or a cellular responses of the cells associated with angiogenesis comprising one or more of bioenergetics, cell proliferation, apoptosis, organellar function, cell migration, tube formation, enzyme activity, chemotaxis, extracellular matrix degradation, sprouting, and a genotype-phenotype association actualized by functional models selected from ATP, ROS, OXPHOS, and Seahorse assays.

In any of the embodiments of the invention, the first data set can be a single data set such as one of genomic data, lipidomic data, proteomic data, metabolic data, transcriptomic data, and single nucleotide polymorphism (SNP) data. In any of the embodiment, the first data set can be a two data sets. In any of the embodiment, the first data set is three data sets. In any of the embodiment, the first data set can be four data sets. In any of the embodiment, the first data set can be five data sets. In any of the embodiment, the first data set can be six data sets.

In any of the embodiments of the invention, the second data set is a single data set such as one of one or more functional activities or a cellular responses of the cells associated with angiogenesis comprising one or more of bioenergetics, cell proliferation, apoptosis, organellar function, cell migration, tube formation, enzyme activity, chemotaxis, extracellular matrix degradation, sprouting, and a genotype-phenotype association actualized by functional models selected from ATP, ROS, OXPHOS, and Seahorse assay data. In any of the embodiment, the second data set can be two data sets. In any of the embodiment, the second data set can be three data sets. In certain embodiments, the second data set can be four data sets. In any of the embodiment, the second data set can be five data sets. In any of the embodiment, the second data set can be six data sets. In any of the embodiment, the second data set can be seven data sets. In any of the embodiment, the second data set can be eight data sets. In any of the embodiment, the second data set can be nine data sets. In certain embodiments, the second data set can be ten data sets.

In any of the embodiments of the invention, the enzyme activity can be a kinase activity. In any of the embodiments of the invention, the enzyme activity can be a protease activity.

In certain of the embodiments of the invention, step (4) is carried out by an artificial intelligence (AI)-based informatics platform. In certain embodiments, the AI-based informatics platform comprises REFS™. In certain embodiments, the AI-based informatics platform receives all data input from the first data set and the second data set without applying a statistical cut-off point. In certain embodiments, the consensus causal relationship network established in step (4) is further refined to a simulation causal relationship network, before step (5), by in silico simulation based on input data, to provide a confidence level of prediction for one or more causal relationships within the consensus causal relationship network.

In certain embodiments of the invention, the unique causal relationship is identified as part of a differential causal relationship network that is uniquely present in cells, and absent in the matching control cells.

In the invention, the unique causal relationship identified is a relationship between at least one pair selected from the group consisting of expression of a gene and level of a lipid; expression of a gene and level of a transcript; expression of a gene and level of a metabolite; expression of a first gene and expression of a second gene; expression of a gene and presence of a SNP; expression of a gene and a functional activity; level of a lipid and level of a transcript; level of a lipid and level of a metabolite; level of a first lipid and level of a second lipid; level of a lipid and presence of a SNP; level of a lipid and a functional activity; level of a first transcript and level of a second transcript; level of a transcript and level of a metabolite; level of a transcript and presence of a SNP; level of a first transcript and level of a functional activity; level of a first metabolite and level of a second metabolite; level of a metabolite and presence of a SNP; level of a metabolite and a functional activity; presence of a first SNP and presence of a second SNP; and presence of a SNP and a functional activity.

In certain embodiments, the functional activity is selected from the group consisting of bioenergetics, cell proliferation, apoptosis, organellar function, cell migration, tube formation, enzyme activity, chemotaxis, extracellular matrix degradation, and sprouting, and a genotype-phenotype association actualized by functional models selected from ATP, ROS, OXPHOS, and Seahorse assays. In certain embodiments, the functional activity is kinase activity. In certain embodiments, the functional activity is protease activity.

In certain embodiments of the invention, the unique causal relationship identified is a relationship between at least a level of a lipid, expression of a gene, and one or more functional activities wherein the functional activity is a kinase activity.

In the invention, the methods can further comprise validating the identified unique causal relationship in angiogenesis.

The invention provides methods for providing a model for angiogenesis for use in a platform methods, comprising:

establishing a model for angiogenesis, using cells associated with angiogenesis, to represent a characteristic aspect of angiogenesis, wherein the model for angiogenesis is useful for generating data sets used in the platform method;

thereby providing a model for angiogenesis for use in a platform method.

The invention provides methods for obtaining a first data set and second data set from a model for angiogenesis for use in a platform method, comprising:

(1) obtaining a first data set from the model for angiogenesis for use in a platform method, wherein the model for angiogenesis comprises cells associated with angiogenesis, and wherein the first data set represents one or more of genomic data, lipidomic data, proteomic data, metabolic data, transcriptomic data, and single nucleotide polymorphism (SNP) data characterizing the cells associated with angiogenesis;

(2) obtaining a second data set from the model for angiogenesis for use in the platform method, wherein the second data set represents one or more functional activities or cellular responses of the cells associated with angiogenesis;

thereby obtaining a first data set and second data set from the model for angiogenesis for use in a platform method.

The invention provides methods for identifying a modulator of angiogenesis, said method comprising:

(1) generating a consensus causal relationship network among a first data set and second data set obtained from a model for angiogenesis, wherein the model comprises cells associated with angiogenesis, and wherein the first data set represents one or more of genomic data, lipidomic data, proteomic data, metabolic data, transcriptomic data, and single nucleotide polymorphism (SNP) data characterizing the cells associated with angiogenesis; and the second data set represents one or more functional activities or cellular responses of the cells associated with angiogenesis, using a programmed computing device, wherein the generation of the consensus causal relationship network is not based on any known biological relationships other than the first data set and the second data set;

(2) identifying, from the consensus causal relationship network, a causal relationship unique in angiogenesis, wherein at least one of a gene, a lipid, a protein, a metabolite, a transcript, or a SNP associated with the unique causal relationship is identified as a modulator of angiogenesis;

thereby identifying a modulator of angiogenesis.

The invention provides methods for identifying a modulator of angiogenesis, said method comprising:

(1) providing a consensus causal relationship network generated from a model for angiogenesis;

(2) identifying, from the consensus causal relationship network, a causal relationship unique in angiogenesis, wherein at least one of a gene, a lipid, a protein, a metabolite, a transcript, or a SNP associated with the unique causal relationship is identified as a modulator of angiogenesis;

thereby identifying a modulator of angiogenesis.

In certain embodiments, the consensus causal relationship network is generated among a first data set and second data set obtained from the model for angiogenesis, wherein the model comprises cells associated with angiogenesis, and wherein the first data set represents one or more of genomic data, lipidomic data, proteomic data, metabolic data, transcriptomic data, and single nucleotide polymorphism (SNP) data characterizing the cells associated with angiogenesis; and the second data set represents one or more functional activities or cellular responses of the cells associated with angiogenesis, using a programmed computing device, wherein the generation of the consensus causal relationship network is not based on any known biological relationships other than the first data set and the second data set.

In certain embodiments, the model for angiogenesis is selected from the group consisting of in vitro cell culture angiogenesis model, rat aorta microvessel model, newborn mouse retina model, chick chorioallantoic membrane (CAM) model, corneal angiogenic growth factor pocket model, subcutaneous sponge angiogenic growth factor implantation model, MATRIGEL® angiogenic growth factor implantation model, and tumor implanation model; and wherein the model of angiogenesis optionally further comprises a matching control model of angiogenesis comprising control cells.

In certain embodiments, the first data set comprises lipidomics data. In certain embodiments, the first data set comprises only lipidomics data.

In certain embodiments, the second data set represents one or more functional activities or cellular responses of the cells associated with angiogenesis comprising global enzymatic activity, and an effecot of the global enzymatic activity on the enzyme metabolites or substrates in the cells associated with angiogenesis.

In certain embodiments, the second data set comprises kinase activity or protease activity. In certain embodiments, the second data set comprises only kinase activity or protease activity.

In certain embodiments, the second data set represents one or more functional activities or cellular responses of the cells associated with angiogenesis comprises one or more of bioenergetics profiling, cell proliferation, apoptosis, organellar function, cell migration, tube formation, kinase activity, and protease activity; and a genotype-phenotype association actualized by functional models selected from ATP, ROS, OXPHOS, and Seahorse assays.

In certain embodiments of the invention, the angiogenesis is related to a disease state.

The invention provides methods for modulating angiogenesis in a mammalian subject, the methods comprising:

administering to the mammal in need thereof a therapeutically effective amount of a pharmaceutical composition comprising a biologically active substance that affects the modulator identified by any one of the methods provided herein, thereby modulating angiogenesis.

The invention provides method of detecting modulated angiogenesis in a mammalian subject, the method comprising:

determining a level, activity, or presence, in a biological sample obtained from the subject, of one or more modulators identified by any one of the methods provided herein; and comparing the level, activity, or presence in the subject with the level, activity, or presence of the one or more modulators in a control sample, wherein a difference between the level, activity, or presence in the subject and the level, activity, or presence of the one or more modulators in the control sample is an indication that angiogenesis is modulated in the mammalian subject.

The invention provides methods of identifying a therapeutic compound for modulating angiogenesis in a mammalian subject, the methods comprising:

contacting a biological sample from a mammalian subject with a test compound;

determining the level of expression, in the biological sample, of one or more modulators identified by any one of the methods provided herein;

comparing the level, activity, or presence of the one or more modulators in the biological sample with a control sample not contacted by the test compound; and selecting the test compound that modulates the level, activity, or presence of the one or more modulators in the biological sample, thereby identifying a therapeutic compound for modulating angiogenesis in a mammalian subject.

The invention provides methods for modulating angiogenesis in a mammalian subject, the methods comprising:

administering to the mammal in need thereof a therapeutically effective amount of a pharmaceutical composition comprising the therapeutic compound identified by any of the methods provided herein, thereby treating, alleviating a symptom of, inhibiting progression of, preventing, diagnosing, or prognosing the disease.

In certain embodiments, the "environmental perturbation", also referred to herein as "external stimulus component", is a therapeutic agent. In certain embodiments, the external stimulus component is a small molecule (e.g., a small molecule of no more than 5 kDa, 4 kDa, 3 kDa, 2 kDa, 1 kDa, 500 Dalton, or 250 Dalton). In certain embodiments, the external stimulus component is a biologic. In certain embodiments, the external stimulus component is a chemical. In certain embodiments, the external stimulus component is endogenous or exogenous to cells. In certain embodiments, the external stimulus component is a MIM or epishifter. In certain embodiments, the external stimulus component is a stress factor for the cell system, such as hypoxia, hyperglycemia, hyperlipidemia, hyperinsulinemia, and/or lactic acid rich conditions.

In certain embodiments, the external stimulus component may include a therapeutic agent or a candidate therapeutic agent for treating a disease condition, including chemotherapeutic agent, protein-based biological drugs, antibodies, fusion proteins, small molecule drugs, lipids, polysaccharides, nucleic acids, etc.

In certain embodiments, the external stimulus component may be one or more stress factors, such as those typically encountered in vivo under the various disease conditions, including hypoxia, hyperglycemic conditions, acidic environment (that may be mimicked by lactic acid treatment), etc.

In other embodiments, the external stimulus component may include one or more MIMs and/or epishifters, as defined herein below. Exemplary MIMs include Coenzyme Q10 (also referred to herein as CoQ10) and compounds in the Vitamin B family, or nucleosides, mononucleotides or dinucleotides that comprise a compound in the Vitamin B family. In certain embodiments, the external stimulus is not CoQ10. In certain embodiments, the external stimulus is not Vitamin B or a compound in the Vitamin B family.

In making cellular output measurements (such as protein expression, lipid level), either absolute amount (e.g., expression or total amount) or relative level (e.g., relative expression level or amount) may be used. In one embodiment, absolute amounts (e.g., expression or total amounts) are used. In one embodiment, relative levels or amounts (e.g., relative expression levels or amounts) are used. For example, to determine the relative protein expression level of a cell system, the amount of any given protein in the cell system, with or without the external stimulus to the cell system, may be compared to a suitable control cell line or mixture of cell lines (such as all cells used in the same experiment) and given a fold-increase or fold-decrease value. The skilled person will appreciate that absolute amounts or relative amounts can be employed in any cellular output measurement, such as gene and/or RNA transcription level, level of lipid, or any functional output, e.g., level of apoptosis, level of toxicity, or ECAR or OCR as described herein. A pre-determined threshold level for a fold-increase (e.g., at least 1.2, 1.3, 1.4, 1.5, 1.6, 1.7, 1.8, 1.9, 2, 2.5, 3, 3.5, 4, 4.5, 5, 6, 7, 8, 9, 10, 15, 20, 25, 30, 35, 40, 45, 50, 75 or 100 or more fold increase) or fold-decrease (e.g., at least a decrease to 0.9, 0.8, 0.75, 0.7, 0.6, 0.5, 0.45, 0.4, 0.35, 0.3, 0.25, 0.2, 0.15, 0.1 or 0.05 fold, or a decrease to 90%, 80%, 75%, 70%, 65%, 60%, 55%, 50%, 45%, 40%, 35%, 30%, 25%, 20%, 15%, 10% or 5% or less) may be used to select significant differentials, and the cellular output data for the significant differentials may then be included in the data sets (e.g., first and second data sets) utilized in the platform technology methods of the invention. All values presented in the foregoing list can also be the upper or lower limit of ranges, e.g., between 1.5 and 5 fold, 5 and 10 fold, 2 and 5 fold, or between 0.9 and 0.7, 0.9 and 0.5, or 0.7 and 0.3 fold, are intended to be a part of this invention.

Throughout the present application, all values presented in a list, e.g., such as those above, can also be the upper or lower limit of ranges that are intended to be a part of this invention.

In one embodiment of the methods of the invention, not every observed causal relationship in a causal relationship network may be of biological significance. With respect to any given biological system for which the subject interrogative biological assessment is applied, some (or maybe all) of the causal relationships (and the genes associated therewith) may be "determinative" with respect to the specific biological problem at issue, e.g., either responsible for causing a disease condition (a potential target for therapeutic intervention) or is a biomarker for the disease condition (a potential diagnostic or prognostic factor). In one embodiment, an observed causal relationship unique in the biological system is determinative with respect to the specific biological problem at issue. In one embodiment, not every observed causal relationship unique in the biological system is determinative with respect to the specific problem at issue.

Such determinative causal relationships may be selected by an end user of the subject method, or it may be selected by a bioinformatics software program, such as REFS, DAVID-enabled comparative pathway analysis program, or the KEGG pathway analysis program. In certain embodiments, more than one bioinformatics software program is used, and consensus results from two or more bioinformatics software programs are preferred.

As used herein, "differentials" of cellular outputs include differences (e.g., increased or decreased levels) in any one or more parameters of the cellular outputs. In certain embodiments, the differentials are each independently selected from the group consisting of differentials in mRNA transcription, protein expression, protein activity, metabolite/intermediate level, and/or ligand-target interaction. For example, in terms of protein expression level, differentials between two cellular outputs, such as the outputs associated with a cell system before and after the treatment by an external stimulus component, can be measured and quantitated by using art-recognized technologies, such as mass-spectrometry based assays (e.g., iTRAQ, 2D-LC-MSMS, etc.).

In one aspect, the cell model for a biological system comprises a cellular cross-talking system, wherein a first cell system having a first cellular environment with an external stimulus component generates a first modified cellular environment; such that a cross-talking cell system is established by exposing a second cell system having a second cellular environment to the first modified cellular environment.

In one embodiment, at least one significant cellular cross-talking differential from the cross-talking cell system is generated; and at least one determinative cellular cross-talking differential is identified such that an interrogative biological assessment occurs. In certain embodiments, the at least one significant cellular cross-talking differential is a plurality of differentials.

In certain embodiments, the at least one determinative cellular cross-talking differential is selected by the end user. Alternatively, in another embodiment, the at least one determinative cellular cross-talking differential is selected by a bioinformatics software program (such as, e.g., REFS, KEGG pathway analysis or DAVID-enabled comparative pathway analysis) based on the quantitative proteomics data.

In certain embodiments, the method further comprises generating a significant cellular output differential for the first cell system.

In certain embodiments, the differentials are each independently selected from the group consisting of differentials in mRNA transcription, protein expression, protein activity, metabolite/intermediate level, and/or ligand-target interaction.

In certain embodiments, the first cell system and the second cell system are independently selected from: a homogeneous population of primary cells, a cancer cell line, or a normal cell line.

In certain embodiments, the first modified cellular environment comprises factors secreted by the first cell system into the first cellular environment, as a result of contacting the first cell system with the external stimulus component. The factors may comprise secreted proteins or other signaling molecules. In certain embodiments, the first modified cellular environment is substantially free of the original external stimulus component.

In certain embodiments, the cross-talking cell system comprises a transwell having an insert compartment and a well compartment separated by a membrane. For example, the first cell system may grow in the insert compartment (or the well compartment), and the second cell system may grow in the well compartment (or the insert compartment).

In certain embodiments, the cross-talking cell system comprises a first culture for growing the first cell system, and a second culture for growing the second cell system. In this case, the first modified cellular environment may be a conditioned medium from the first cell system.

In certain embodiments, the first cellular environment and the second cellular environment can be identical. In certain embodiments, the first cellular environment and the second cellular environment can be different.

In certain embodiments, the cross-talking cell system comprises a co-culture of the first cell system and the second cell system.

The methods of the invention may be used for, or applied to, any number of "interrogative biological assessments." Application of the methods of the invention to an interrogative biological assessment allows for the identification of one or more modulators of a biological system or determinative cellular process "drivers" of a biological system or process.

The methods of the invention may be used to carry out a broad range of interrogative biological assessments. In certain embodiments, the interrogative biological assessment is the diagnosis of a disease state. In certain embodiments, the interrogative biological assessment is the determination of the efficacy of a drug. In certain embodiments, the interrogative biological assessment is the determination of the toxicity of a drug. In certain embodiments, the interrogative biological assessment is the staging of a disease state. In certain embodiments, the interrogative biological assessment identifies targets for anti-aging cosmetics.

As used herein, an "interrogative biological assessment" may include the identification of one or more modulators of a biological system, e.g., determinative cellular process "drivers," (e.g., an increase or decrease in activity of a biological pathway, or key members of the pathway, or key regulators to members of the pathway) associated with the environmental perturbation or external stimulus component, or a unique causal relationship unique in a biological system or process. It may further include additional steps designed to test or verify whether the identified determinative cellular process drivers are necessary and/or sufficient for the downstream events associated with the environmental perturbation or external stimulus component, including in vivo animal models and/or in vitro tissue culture experiments.

In certain embodiments, the interrogative biological assessment is the diagnosis or staging of a disease state, wherein the identified modulators of a biological system, e.g., determinative cellular process drivers (e.g., cross-talk differentials or causal relationships unique in a biological system or process) represent either disease markers or therapeutic targets that can be subject to therapeutic intervention. The subject interrogative biological assessment is suitable for any disease condition in theory, but may found particularly useful in areas such as oncology/cancer biology, diabetes, obesity, cardiovascular disease, and neurological conditions (especially neuro-degenerative diseases, such as, without limitation, Alzheimer's disease, Parkinson's disease, Huntington's disease, Amyotrophic lateral sclerosis (ALS), and aging related neurodegeneration), and conditions associated with angiogenesis.

In certain embodiments, the interrogative biological assessment is the determination of the efficacy of a drug, wherein the identified modulators of a biological system, e.g., determinative cellular process driver (e.g., cross-talk differentials or causal relationships unique in a biological system or process) may be the hallmarks of a successful drug, and may in turn be used to identify additional agents, such as MIMs or epishifters, for treating the same disease condition.

In certain embodiments, the interrogative biological assessment is the identification of drug targets for preventing or treating infection, wherein the identified determinative cellular process driver (e.g., cellular cross-talk differentials or causal relationships unique in a biological system or process) may be markers/indicators or key biological molecules causative of the infective state, and may in turn be used to identify anti-infective agents.

In certain embodiments, the interrogative biological assessment is the assessment of a molecular effect of an agent, e.g., a drug, on a given disease profile, wherein the identified modulators of a biological system, e.g., determinative cellular process driver (e.g., cellular cross-talk differentials or causal relationships unique in a biological system or process) may be an increase or decrease in activity of one or more biological pathways, or key members of the pathway(s), or key regulators to members of the pathway(s), and may in turn be used, e.g., to predict the therapeutic efficacy of the agent for the given disease.

In certain embodiments, the interrogative biological assessment is the assessment of the toxicological profile of an agent, e.g., a drug, on a cell, tissue, organ or organism, wherein the identified modulators of a biological system, e.g., determinative cellular process driver (e.g., cellular cross-talk differentials or causal relationships unique in a biological system or process) may be indicators of toxicity, e.g., cytotoxicity, and may in turn be used to predict or identify the toxicological profile of the agent. In one embodiment, the identified modulators of a biological system, e.g., determinative cellular process driver (e.g., cellular cross-talk differentials or causal relationships unique in a biological system or process) is an indicator of cardiotoxicity of a drug or drug candidate, and may in turn be used to predict or identify the cardiotoxicological profile of the drug or drug candidate.

In certain embodiments, the interrogative biological assessment is the identification of drug targets for preventing or treating a disease or disorder caused by biological weapons, such as disease-causing protozoa, fungi, bacteria, protests, viruses, or toxins, wherein the identified modulators of a biological system, e.g., determinative cellular process driver (e.g., cellular cross-talk differentials or causal relationships unique in a biological system or process) may be markers/indicators or key biological molecules causative of said disease or disorder, and may in turn be used to identify biodefense agents.

In certain embodiments, the interrogative biological assessment is the identification of targets for anti-aging agents, such as anti-aging cosmetics, wherein the identified modulators of a biological system, e.g., determinative cellular process driver (e.g., cellular cross-talk differentials or causal relationships unique in a biological system or process) may be markers or indicators of the aging process, particularly the aging process in skin, and may in turn be used to identify anti-aging agents.

In one exemplary cell model for aging that is used in the methods of the invention to identify targets for anti-aging cosmetics, the cell model comprises an aging epithelial cell that is, for example, treated with UV light (an environmental perturbation or external stimulus component), and/or neonatal cells, which are also optionally treated with UV light. In one embodiment, a cell model for aging comprises a cellular cross-talk system. In one exemplary two-cell cross-talk system established to identify targets for anti-aging cosmetics, an aging epithelial cell (first cell system) may be treated with UV light (an external stimulus component), and changes, e.g., proteomic changes and/or functional changes, in a neonatal cell (second cell system) resulting from contacting the neonatal cells with conditioned medium of the treated aging epithelial cell may be measured, e.g., proteome changes may be measured using conventional quantitative mass spectrometry, or a causal relationship unique in aging may be identified from a causal relationship network generated from the data.

In another aspect, the invention provides a kit for conducting an interrogative biological assessment using a discovery Platform Technology, comprising one or more reagents for detecting the presence of, and/or for quantitating the amount of, an analyte that is the subject of a causal relationship network generated from the methods of the invention. In one embodiment, said analyte is the subject of a unique causal relationship in the biological system, e.g., a gene associated with a unique causal relationship in the biological system. In certain embodiments, the analyte is a protein, and the reagents comprise an antibody against the protein, a label for the protein, and/or one or more agents for preparing the protein for high throughput analysis (e.g., mass spectrometry based sequencing).

In yet another aspect, the technology provides a method for treating, alleviating a symptom of, inhibiting progression of, preventing, diagnosing, or prognosing a disease in a mammalian subject. The method includes administering to the mammal in need thereof a therapeutically effective amount of a pharmaceutical composition comprising a biologically active substance that affects expression or activity of any one or more of TCOF1, TOP2A, CAMK2A, CDK1, CLTCL1, EIF4G1, ENO1, FBL, GSK3B, HDLBP, HIST1H2BA, HMGB2, HNRNPK, HNRPDL, HSPA9, MAP2K2, LDHA, MAP4, MAPK1, MARCKS, NME1, NME2, PGK1, PGK2, RAB7A, RPL17, RPL28, RPS5, RPS6, SLTM, TMED4, TNRCBA, TUBB, and UBE21, thereby treating, alleviating a symptom of, inhibiting progression of, preventing, diagnosing, or prognosing the disease. In some embodiments, the disease is a cancer, for example hepatocellular carcinoma. In various embodiments, the method can use 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, or 34 of the kinases. In one embodiment, the composition increases expression and/or activity of one or more of the kinases. In another embodiment, the composition decreases expression and/or activity of one or more of the kinases.

In still yet another aspect, the technology provides a method of diagnosing a disease in a mammalian subject. The method includes (i) determining an expression or activity level, in a biological sample obtained from the subject, of any one or more of TCOF1, TOP2A, CAMK2A, CDK1, CLTCL1, EIF4G1, ENO1, FBL, GSK3B, HDLBP, HIST1H2BA, HMGB2, HNRNPK, HNRPDL, HSPA9, MAP2K2, LDHA, MAP4, MAPK1, MARCKS, NME1, NME2, PGK1, PGK2, RAB7A, RPL17, RPL28, RPS5, RPS6, SLTM, TMED4, TNRCBA, TUBB, and UBE21, and (ii) comparing the level in the subject with the level of expression or activity of the one or more proteins in a control sample, wherein a difference between the level in the subject and the level of expression or activity of the one or more proteins in the control sample is an indication that the subject is afflicted with a disease, or predisposed to developing a disease, or responding favorably to a therapy for a disease, thereby diagnosing the disease in the mammalian subject. In some embodiments, the disease is a cancer, for example hepatocellular carcinoma. In various embodiments, the method can use 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, or 34 of the kinases. In one embodiment, the difference is an increase in expression and/or activity of one or more of the kinases. In another embodiment, the difference is a decrease in expression and/or activity of one or more of the kinases.

In yet another aspect, the technology provides a method of identifying a therapeutic compound for treating, alleviating a symptom of, inhibiting progression of, preventing, diagnosing, or prognosing a disease in a mammalian subject. The method includes (i) contacting a biological sample from a mammalian subject with a test compound, (ii) determining the level of expression, in the biological sample, of any one or more of TCOF1, TOP2A, CAMK2A, CDK1, CLTCL1, EIF4G1, ENO1, FBL, GSK3B, HDLBP, HIST1H2BA, HMGB2, HNRNPK, HNRPDL, HSPA9, MAP2K2, LDHA, MAP4, MAPK1, MARCKS, NME1, NME2, PGK1, PGK2, RAB7A, RPL17, RPL28, RPS5, RPS6, SLTM, TMED4, TNRCBA, TUBB, and UBE21, (iii) comparing the level of expression of the one or more proteins in the biological sample with a control sample not contacted by the test compound, and (iv) selecting the test compound that modulates the level of expression of the one or more proteins in the biological sample, thereby identifying a therapeutic compound for treating, alleviating a symptom of, inhibiting progression of, preventing, diagnosing, or prognosing a disease in a mammalian subject. In some embodiments, the disease is a cancer, for example hepatocellular carcinoma. In various embodiments, the method can use 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, or 34 of the kinases. In one embodiment, the compound increases expression and/or activity of one or more of the kinases. In another embodiment, the compound decreases expression and/or activity of one or more of the kinases.

In still yet another aspect, the technology provides a method for treating, alleviating a symptom of, inhibiting progression of, preventing, diagnosing, or prognosing a disease in a mammalian subject. The method comprising administering to the mammal in need thereof a therapeutically effective amount of a pharmaceutical composition comprising the therapeutic compound identified by the aspect above (i.e., utilizing any one or more of TCOF1, TOP2A, CAMK2A, CDK1, CLTCL1, EIF4G1, ENO1, FBL, GSK3B, HDLBP, HIST1H2BA, HMGB2, HNRNPK, HNRPDL, HSPA9, MAP2K2, LDHA, MAP4, MAPK1, MARCKS, NME1, NME2, PGK1, PGK2, RAB7A, RPL17, RPL28, RPS5, RPS6, SLTM, TMED4, TNRCBA, TUBB, and UBE21), thereby treating, alleviating a symptom of, inhibiting progression of, preventing, diagnosing, or prognosing the disease. In some embodiments, the disease is a cancer, for example hepatocellular carcinoma. In various embodiments, the method can use 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, or 34 of the kinases.

It should be understood that all embodiments described herein, including those described only in examples, are parts of the general description of the invention, and can be combined with any other embodiments of the invention unless explicitly disclaimed or inapplicable.

BRIEF DESCRIPTION OF THE DRAWINGS

Various embodiments of the present disclosure will be described herein below with reference to the figures wherein:

FIGS. 59B and 59C are exploded portions of FIG. 59A.

DETAILED DESCRIPTION OF THE INVENTION

I. Overview

Figure 1:
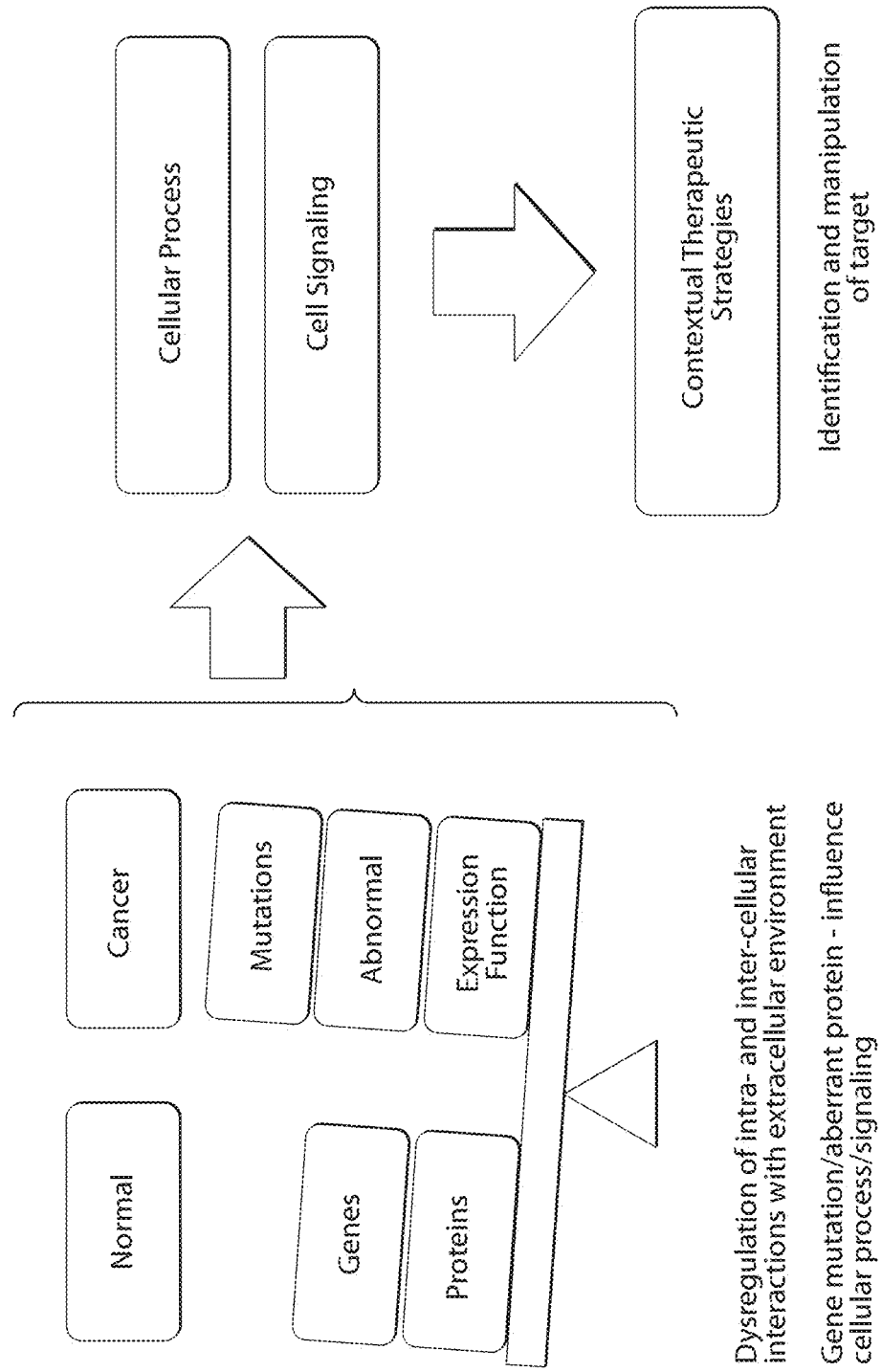
FIG. 1: Illustration of approach to identify therapeutics.

Exemplary embodiments of the present invention incorporate methods that may be performed using an interrogative biology platform ("the Platform") that is a tool for understanding a wide variety of biological processes, such as disease pathophysiology or angiogenesis, and the key molecular drivers underlying such biological processes, including factors that enable a disease process. Some exemplary embodiments include systems that may incorporate at least a portion of, or all of, the Platform. Some exemplary methods may employ at least some of, or all of the Platform. Goals and objectives of some exemplary embodiments involving the platform are generally outlined below for illustrative purposes:

i) to create specific molecular signatures as drivers of critical components of the biological process (e.g., disease process, angiogenesis) as they relate to the overall e biological process;

ii) to generate molecular signatures or differential maps pertaining to the biological process, which may help to identify differential molecular signatures that distinguishes one biological state (e.g., a disease state, angiogenic state) versus a different biological stage (e.g., a normal state), and develop understanding of signatures or molecular entities as they arbitrate mechanisms of change between the two biological states (e.g., from normal to disease state or angiogenic state); and, iii) to investigate the role of "hubs" of molecular activity as potential intervention targets for external control of the biological process (e.g., to use the hub as a potential therapeutic target or target for the modulation of angiogenesis), or as potential bio-markers for the biological process in question (e.g., disease specific biomarkers and angiogenic specific markers, in prognostic and/or theranostics uses).

Some exemplary methods involving the Platform may include one or more of the following features:

1) modeling the biological process (e.g., disease process, angiogenic process) and/or components of the biological process (e.g., disease physiology and pathophysiology, physiology of angiogenesis) in one or more models, preferably in vitro models or laboratory models (e.g., CAM models, corneal pocket models, MATRIGEL® models), using cells associated with the biological process. For example, the cells may be human derived cells which normally participate in the biological process in question. The model may include various cellular cues/conditions/perturbations that are specific to the biological process (e.g., disease, angiogenesis). Ideally, the model represents various (disease, angiogenensis) states and flux components, instead of a static assessment of the biological (disease, angiogenensis) condition.

2) profiling mRNA and/or protein signatures using any art-recognized means. For example, quantitative polymerase chain reaction (qPCR) and proteomics analysis tools such as Mass Spectrometry (MS). Such mRNA and protein data sets represent biological reaction to environment/perturbation. Where applicable and possible, lipidomics, metabolomics, and transcriptomics data may also be integrated as supplemental or alternative measures for the biological process in question. SNP analysis is another component that may be used at times in the process. It may be helpful for investigating, for example, whether the SNP or a specific mutation has any effect on the biological process. These variables may be used to describe the biological process, either as a static "snapshot," or as a representation of a dynamic process.

3) assaying for one or more cellular responses to cues and perturbations, including but not limited to bioenergetics profiling, cell proliferation, apoptosis, and organellar function. True genotype-phenotype association is actualized by employment of functional models, such as ATP, ROS, OXPHOS, Seahorse assays, caspase assays, migration assays, chemotaxis assays, tube formation assays, etc. Such cellular responses represent the reaction of the cells in the biological process (or models thereof) in response to the corresponding state(s) of the mRNA/protein expression, and any other related states in 2) above.

4) integrating functional assay data thus obtained in 3) with proteomics and other data obtained in 2), and determining protein associations as driven by causality, by employing artificial intelligence based (AI-based) informatics system or platform. Such an AI-based system is based on, and preferably based only on, the data sets obtained in 2) and/or 3), without resorting to existing knowledge concerning the biological process. Preferably, no data points are statistically or artificially cut-off. Instead, all obtained data is fed into the AI-system for determining protein associations. One goal or output of the integration process is one or more differential networks (otherwise may be referred to herein as "delta networks," or, in some cases, "delta-delta networks" as the case may be) between the different biological states (e.g., disease vs. normal states).

5) profiling the outputs from the AI-based informatics platform to explore each hub of activity as a potential therapeutic target and/or biomarker. Such profiling can be done entirely in silico based on the obtained data sets, without resorting to any actual wet-lab experiments.

6) validating hub of activity by employing molecular and cellular techniques. Such post-informatic validation of output with wet-lab cell-based experiments may be optional, but they help to create a full-circle of interrogation.

Any or all of the approaches outlined above may be used in any specific application concerning any biological process, depending, at least in part, on the nature of the specific application. That is, one or more approaches outlined above may be omitted or modified, and one or more additional approaches may be employed, depending on specific application.

Figure 2:
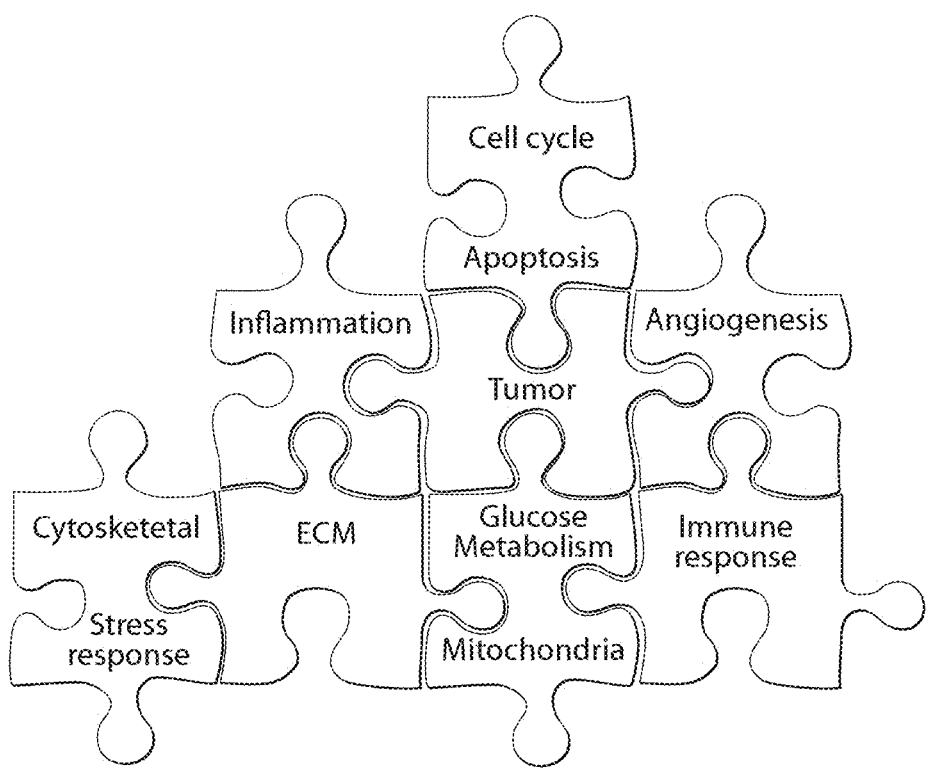
FIG. 2: Illustration of systems biology of cancer and consequence of integrated multi-physiological interactive output regulation.
Figure 3:
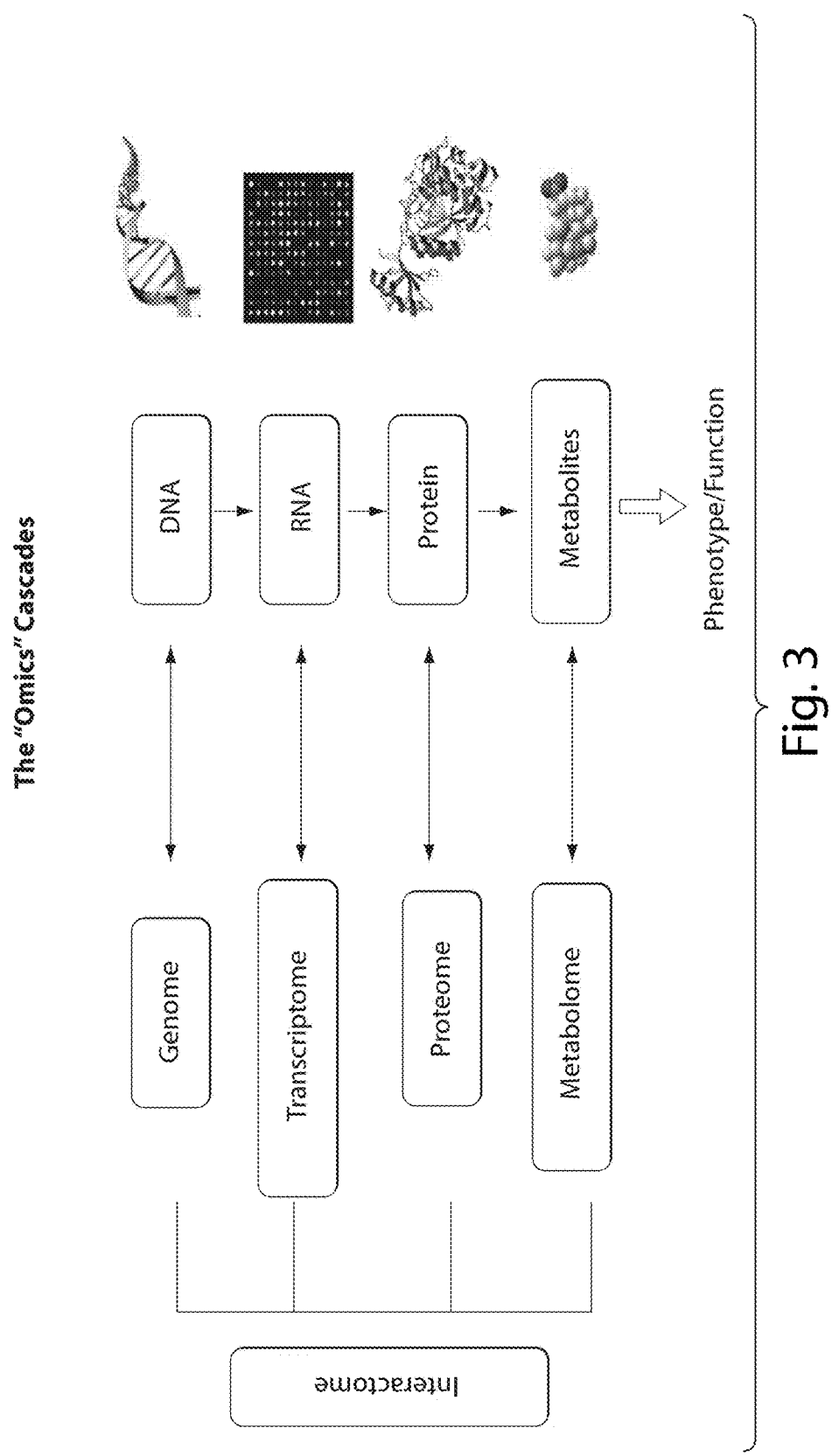
FIG. 3: Illustration of systematic interrogation of biological relevance using MIMS.
Figure 4:
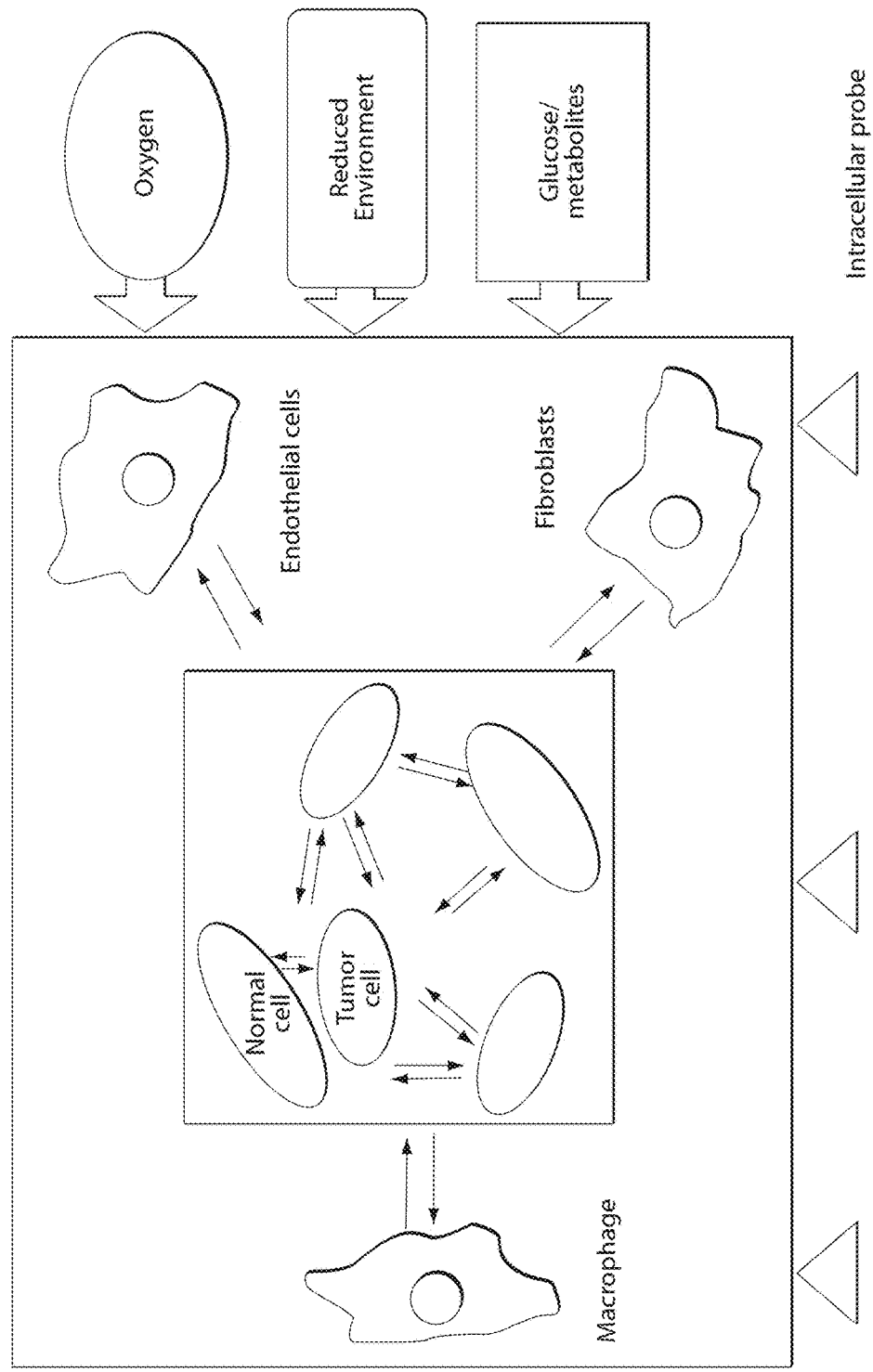
FIG. 4: Illustration of modeling cancer network to enable interrogative biological query.

Various schematics illustrating the platform are provided. In particular, an illustration of an exemplary approach to identify therapeutics using the platform is depicted in FIG. 1. An illustration of systems biology of cancer and the consequence of integrated multi-physiological interactive output regulation is depicted in FIG. 2. An illustration of a systematic interrogation of biological relevance using MIMS is depicted in FIG. 3. An illustration of modeling a cancer network to enable an interrogative biological query is depicted in FIG. 4.

Figure 5:
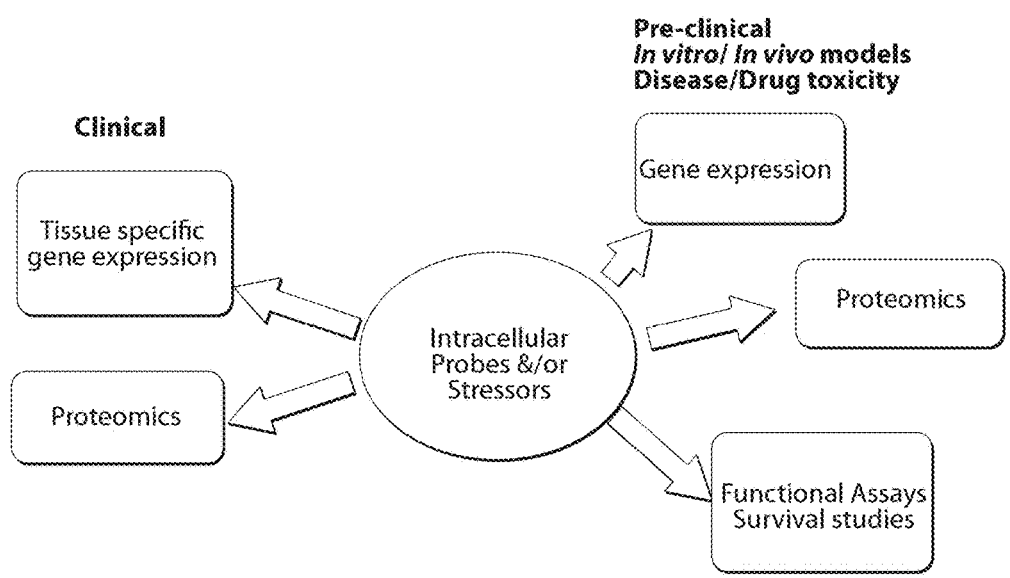
FIG. 5: Illustration of the interrogative biology platform technology.
Figure 6:
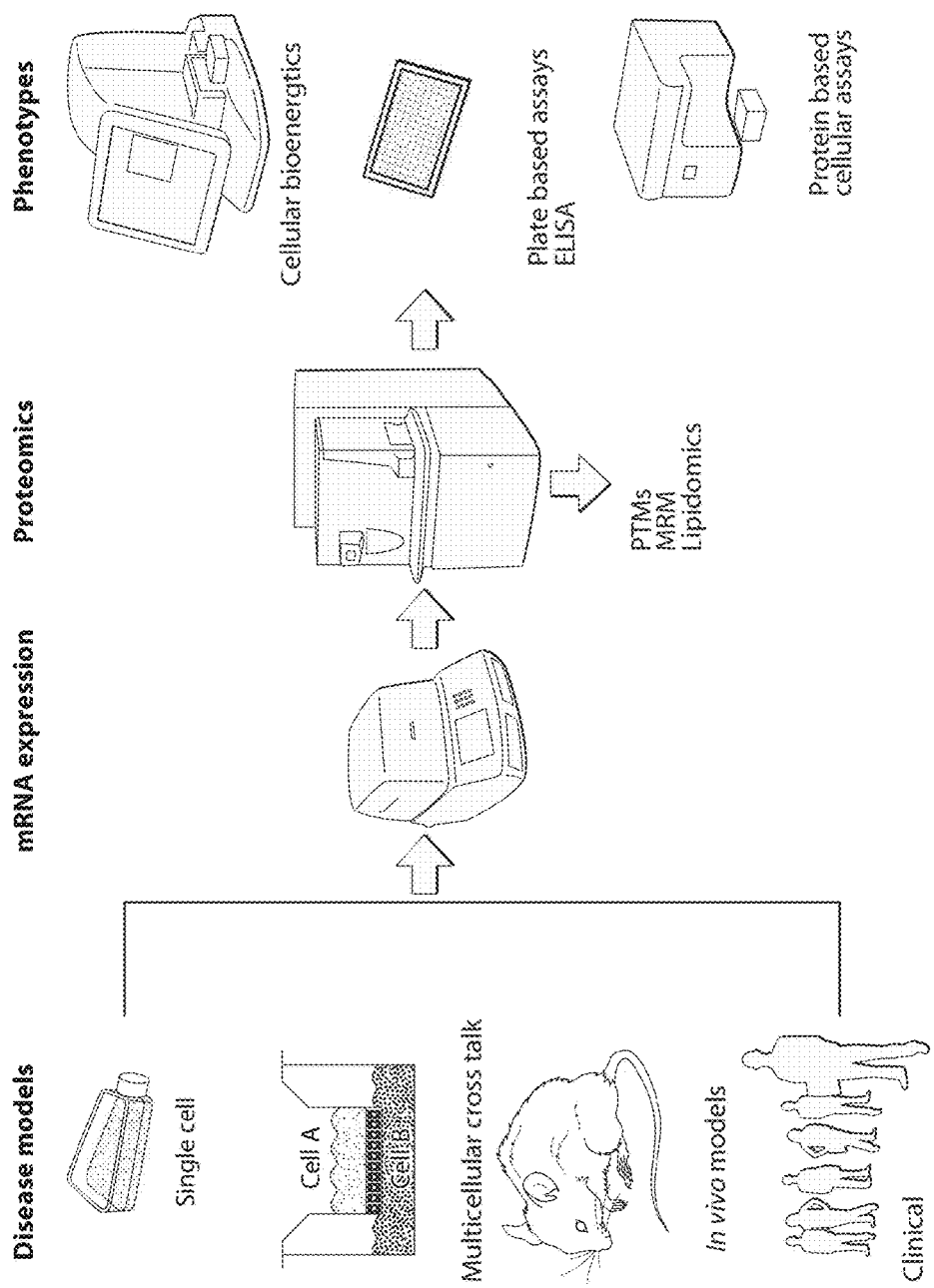
FIG. 6: Illustration of technologies employed in the platform technology.
Figure 7:
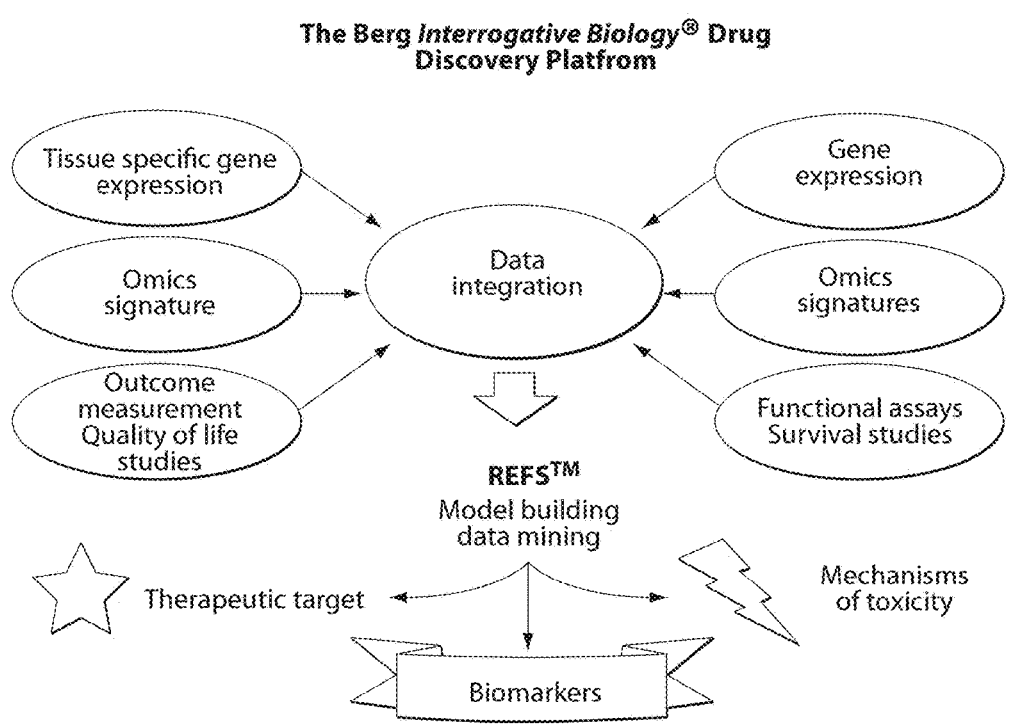
FIG. 7: Schematic representation of the components of the platform including data collection, data integration, and data mining
Figure 8:
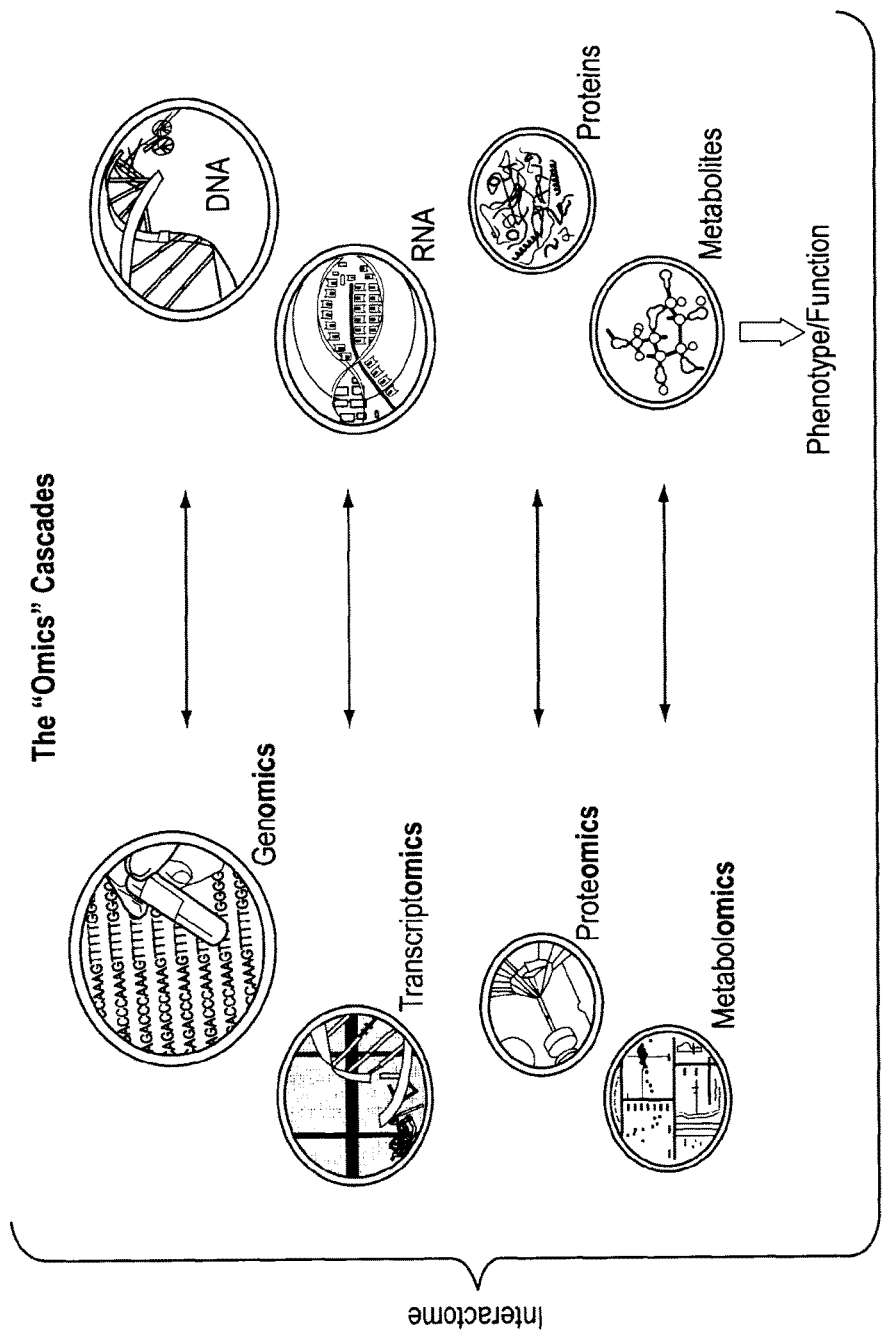
FIG. 8: Schematic representation of the systematic interrogation using MIMS and collection of response data from the "omics" cascade.

Illustrations of the interrogative biology platform and technologies employed in the platform are depicted in FIGS. 5 and 6. A schematic representation of the components of the platform including data collection, data integration, and data mining is depicted in FIG. 7. A schematic representation of a systematic interrogation using MIMS and collection of response data from the "omics" cascade is depicted in FIG. 8.

Figure 14:
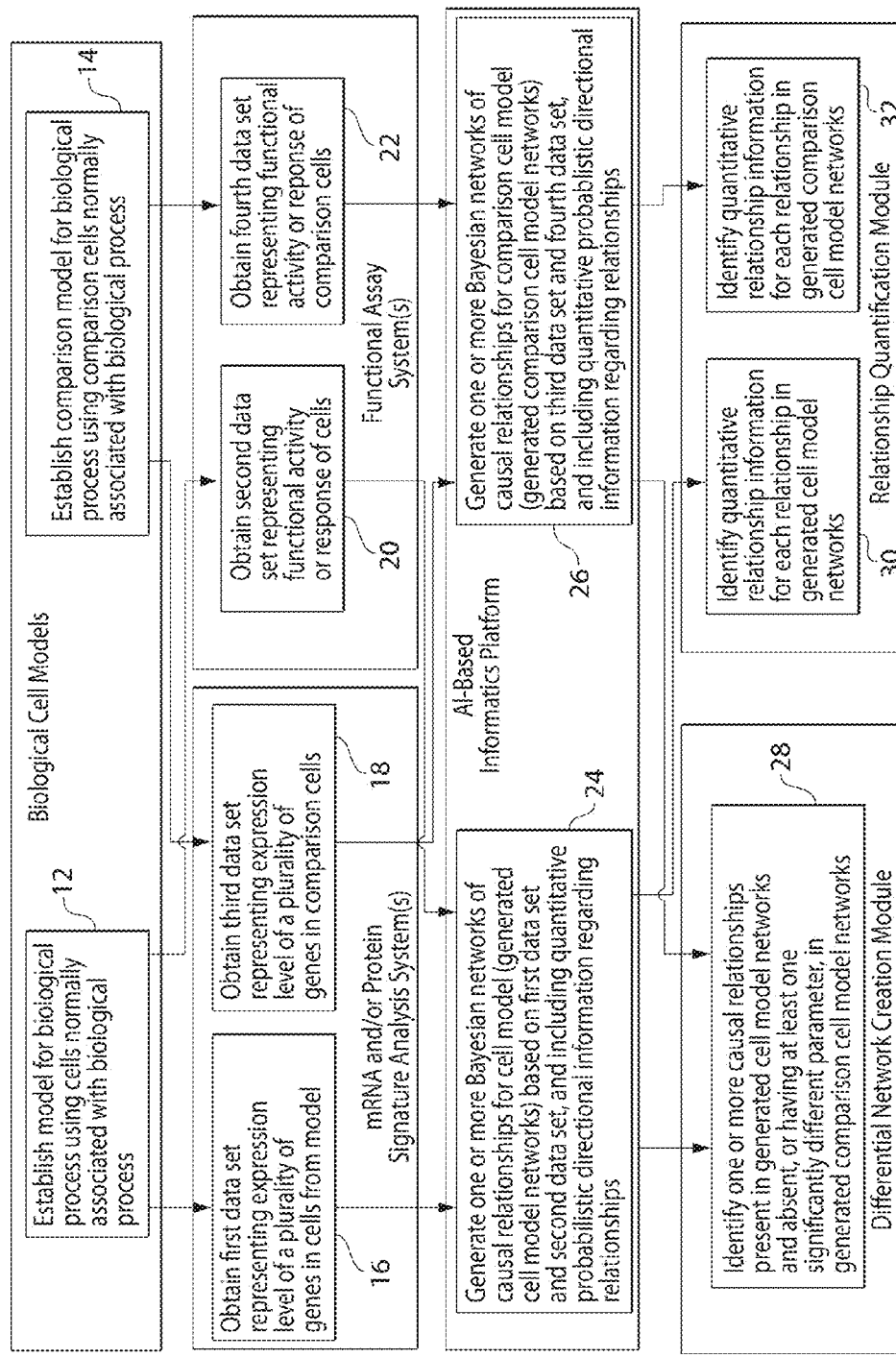
FIG. 14: High level flow chart of an exemplary method, in accordance with some embodiments.

FIG. 14 is a high level flow chart of an exemplary method 10, in which components of an exemplary system that may be used to perform the exemplary method are indicated. Initially, a model (e.g., an in vitro model) is established for a biological process (e.g., a disease process) and/or components of the biological process (e.g., disease physiology and pathophysiology) using cells normally associated with the biological process (step 12). For example, the cells may be human-derived cells that normally participate in the biological process (e.g., disease). The cell model may include various cellular cues, conditions, and/or perturbations that are specific to the biological process (e.g., disease). Ideally, the cell model represents various (disease) states and flux components of the biological process (e.g., disease), instead of a static assessment of the biological process. The comparison cell model may include control cells or normal (e.g., non-diseased) cells. Additional description of the cell models appears below in sections III.A and IV.

A first data set is obtained from the cell model for the biological process, which includes information representing expression levels of a plurality of genes (e.g., mRNA and/or protein signatures) (step 16) using any known process or system (e.g., quantitative polymerase chain reaction (qPCR) and proteomics analysis tools such as Mass Spectrometry (MS)).

A third data set is obtained from the comparison cell model for the biological process (step 18). The third data set includes information representing expression levels of a plurality of genes in the comparison cells from the comparison cell model.

In certain embodiments of the methods of the invention, these first and third data sets are collectively referred to herein as a "first data set" that represents expression levels of a plurality of genes in the cells (all cells including comparison cells) associated with the biological system.

The first data set and third data set may be obtained from one or more mRNA and/or Protein Signature Analysis System(s). The mRNA and protein data in the first and third data sets may represent biological reactions to environment and/or perturbation. Where applicable and possible, lipidomics, metabolomics, and transcriptomics data may also be integrated as supplemental or alternative measures for the biological process. The SNP analysis is another component that may be used at times in the process. It may be helpful for investigating, for example, whether a single-nucleotide polymorphism (SNP) or a specific mutation has any effect on the biological process. The data variables may be used to describe the biological process, either as a static "snapshot," or as a representation of a dynamic process. Additional description regarding obtaining information representing expression levels of a plurality of genes in cells appears below in section III.B.

A second data set is obtained from the cell model for the biological process, which includes information representing a functional activity or response of cells (step 20). Similarly, a fourth data set is obtained from the comparison cell model for the biological process, which includes information representing a functional activity or response of the comparison cells (step 22).

In certain embodiments of the methods of the invention, these second and fourth data sets are collectively referred to herein as a "second data set" that represents a functional activity or a cellular response of the cells (all cells including comparison cells) associated with the biological system.

One or more functional assay systems may be used to obtain information regarding the functional activity or response of cells or of comparison cells. The information regarding functional cellular responses to cues and perturbations may include, but is not limited to, bioenergetics profiling, cell proliferation, apoptosis, and organellar function. Functional models for processes and pathways (e.g., adenosine triphosphate (ATP), reactive oxygen species (ROS), oxidative phosphorylation (OXPHOS), Seahorse assays, caspase assay, migration assay, chemotaxis assay, tube formation assay, etc.,) may be employed to obtain true genotype-phenotype association. The functional activity or cellular responses represent the reaction of the cells in the biological process (or models thereof) in response to the corresponding state(s) of the mRNA/protein expression, and any other related applied conditions or perturbations. Additional information regarding obtaining information representing functional activity or response of cells is provided below in section III.B.

The method also includes generating computer-implemented models of the biological processes in the cells and in the control cells. For example, one or more (e.g., an ensemble of) Bayesian networks of causal relationships between the expression level of the plurality of genes and the functional activity or cellular response may be generated for the cell model (the "generated cell model networks") from the first data set and the second data set (step 24). The generated cell model networks, individually or collectively, include quantitative probabilistic directional information regarding relationships. The generated cell model networks are not based on known biological relationships between gene expression and/or functional activity or cellular response, other than information from the first data set and second data set. The one or more generated cell model networks may collectively be referred to as a consensus cell model network.

One or more (e.g., an ensemble of) Bayesian networks of causal relationships between the expression level of the plurality of genes and the functional activity or cellular response may be generated for the comparison cell model (the "generated comparison cell model networks") from the first data set and the second data set (step 26). The generated comparison cell model networks, individually or collectively, include quantitative probabilistic directional information regarding relationships. The generated cell networks are not based on known biological relationships between gene expression and/or functional activity or cellular response, other than the information in the first data set and the second data set. The one or more generated comparison model networks may collectively be referred to as a consensus cell model network.

The generated cell model networks and the generated comparison cell model networks may be created using an artificial intelligence based (AI-based) informatics platform. Further details regarding the creation of the generated cell model networks, the creation of the generated comparison cell model networks and the AI-based informatics system appear below in section III.C and in the description of FIGS. 2A-3.

It should be noted that many different AI-based platforms or systems may be employed to generate the Bayesian networks of causal relationships including quantitative probabilistic directional information. Although certain examples described herein employ one specific commercially available system, i.e., REFS™ (Reverse Engineering/Forward Simulation) from GNS (Cambridge, Mass.), embodiments are not limited. AI-Based Systems or Platforms suitable to implement some embodiments employ mathematical algorithms to establish causal relationships among the input variables (e.g., the first and second data sets), based only on the input data without taking into consideration prior existing knowledge about any potential, established, and/or verified biological relationships.

For example, the REFS™ AI-based informatics platform utilizes experimentally derived raw (original) or minimally processed input biological data (e.g., genetic, genomic, epigenetic, proteomic, metabolomic, and clinical data), and rapidly performs trillions of calculations to determine how molecules interact with one another in a complete system. The REFS™ AI-based informatics platform performs a reverse engineering process aimed at creating an in silico computer-implemented cell model (e.g., generated cell model networks), based on the input data, that quantitatively represents the underlying biological system. Further, hypotheses about the underlying biological system can be developed and rapidly simulated based on the computer-implemented cell model, in order to obtain predictions, accompanied by associated confidence levels, regarding the hypotheses.

With this approach, biological systems are represented by quantitative computer-implemented cell models in which "interventions" are simulated to learn detailed mechanisms of the biological system (e.g., disease), effective intervention strategies, and/or clinical biomarkers that determine which patients will respond to a given treatment regimen. Conventional bioinformatics and statistical approaches, as well as approaches based on the modeling of known biology, are typically unable to provide these types of insights.

After the generated cell model networks and the generated comparison cell model networks are created, they are compared. One or more causal relationships present in at least some of the generated cell model networks, and absent from, or having at least one significantly different parameter in, the generated comparison cell model networks are identified (step 28). Such a comparison may result in the creation of a differential network. The comparison, identification, and/or differential (delta) network creation may be conducted using a differential network creation module, which is described in further detail below in section III.D and with respect to the description of FIG. 26.

In some embodiments, input data sets are from one cell type and one comparison cell type, which creates an ensemble of cell model networks based on the one cell type and another ensemble of comparison cell model networks based on the one comparison control cell type. A differential may be performed between the ensemble of networks of the one cell type and the ensemble of networks of the comparison cell type(s).

In other embodiments, input data sets are from multiple cell types (e.g., two or more cancer cell types, two or more cell types in different angiogenic states e.g., induced by different pro-angiogenic stimuli) and multiple comparison cell types (e.g., two or more normal, non-cancerous cell types, two or more non-angiogenic and angiogenic cell types). An ensemble of cell model networks may be generated for each cell types and each comparison cell type individually, and/or data from the multiple cell types and the multiple comparison cell types may be combined into respective composite data sets. The composite data sets produce an ensemble of networks corresponding to the multiple cell types (composite data) and another ensemble of networks corresponding to the multiple comparison cell types (comparison composite data). A differential may be performed on the ensemble of networks for the composite data as compared to the ensemble of networks for the comparison composite data.

In some embodiments, a differential may be performed between two different differential networks. This output may be referred to as a delta-delta network, and is described below with respect to FIG. 26.

Quantitative relationship information may be identified for each relationship in the generated cell model networks (step 30). Similarly, quantitative relationship information for each relationship in the generated comparison cell model networks may be identified (step 32). The quantitative information regarding the relationship may include a direction indicating causality, a measure of the statistical uncertainty regarding the relationship (e.g., an Area Under the Curve (AUC) statistical measurement), and/or an expression of the quantitative magnitude of the strength of the relationship (e.g., a fold). The various relationships in the generated cell model networks may be profiled using the quantitative relationship information to explore each hub of activity in the networks as a potential therapeutic target and/or biomarker. Such profiling can be done entirely in silico based on the results from the generated cell model networks, without resorting to any actual wet-lab experiments.

Figure 15:
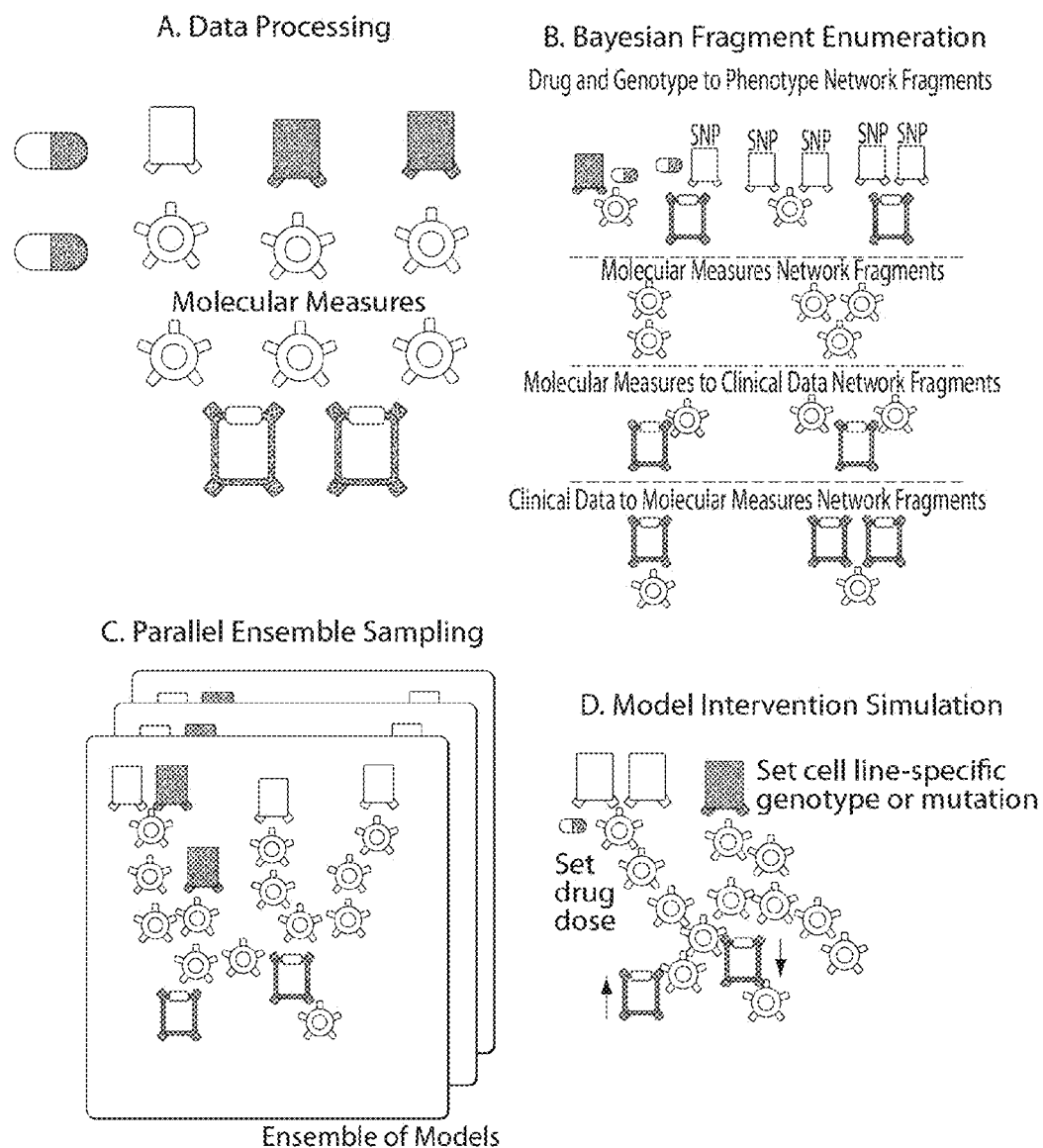
FIG. 15A-15D: High level schematic illustration of the components and process for an AI-based informatics system that may be used with exemplary embodiments.

In some embodiments, a hub of activity in the networks may be validated by employing molecular and cellular techniques. Such post-informatic validation of output with wet-lab cell based experiments need not be performed, but it may help to create a full-circle of interrogation. FIG. 15 schematically depicts a simplified high level representation of the functionality of an exemplary AI-based informatics system (e.g., REFS™ AI-based informatics system) and interactions between the AI-based system and other elements or portions of an interrogative biology platform ("the Platform"). In FIG. 15A, various data sets obtained from a model for a biological process (e.g., a disease model), such as drug dosage, treatment dosage, protein expression, mRNA expression, and any of many associated functional measures (such as OCR, ECAR) are fed into an AI-based system. As shown in FIG. 15B, from the input data sets, the AI-system creates a library of "network fragments" that includes variables (proteins, lipids and metabolites) that drive molecular mechanisms in the biological process (e.g., disease), in a process referred to as Bayesian Fragment Enumeration (FIG. 15B).

In FIG. 15C, the AI-based system selects a subset of the network fragments in the library and constructs an initial trial network from the fragments. The AI-based system also selects a different subset of the network fragments in the library to construct another initial trial network. Eventually an ensemble of initial trial networks are created (e.g., 1000 networks) from different subsets of network fragments in the library. This process may be termed parallel ensemble sampling. Each trial network in the ensemble is evolved or optimized by adding, subtracting and/or substitution additional network fragments from the library. If additional data is obtained, the additional data may be incorporated into the network fragments in the library and may be incorporated into the ensemble of trial networks through the evolution of each trial network. After completion of the optimization/evolution process, the ensemble of trial networks may be described as the generated cell model networks.

As shown in FIG. 15D, the ensemble of generated cell model networks may be used to simulate the behavior of the biological system. The simulation may be used to predict behavior of the biological system to changes in conditions, which may be experimentally verified using wet-lab cell-based, or animal-based, experiments. Also, quantitative parameters of relationships in the generated cell model networks may be extracted using the simulation functionality by applying simulated perturbations to each node individually while observing the effects on the other nodes in the generated cell model networks. Further detail is provided below in section III.C.

The automated reverse engineering process of the AI-based informatics system, which is depicted in FIGS. 2A-2D, creates an ensemble of generated cell model networks that is an unbiased and systematic computer-based model of the cells.

The reverse engineering determines the probabilistic directional network connections between the molecular measurements in the data, and the phenotypic outcomes of interest. The variation in the molecular measurements enables learning of the probabilistic cause and effect relationships between these entities and changes in endpoints. The machine learning nature of the platform also enables cross training and predictions based on a data set that is constantly evolving.

The network connections between the molecular measurements in the data are "probabilistic," partly because the connection may be based on correlations between the observed data sets "learned" by the computer algorithm. For example, if the expression level of protein X and that of protein Y are positively or negatively correlated, based on statistical analysis of the data set, a causal relationship may be assigned to establish a network connection between proteins X and Y. The reliability of such a putative causal relationship may be further defined by a likelihood of the connection, which can be measured by p-value (e.g., $p<0.1$, 0.05, 0.01, etc).

The network connections between the molecular measurements in the data are "directional," partly because the network connections between the molecular measurements, as determined by the reverse-engineering process, reflects the cause and effect of the relationship between the connected gene/protein, such that raising the expression level of one protein may cause the expression level of the other to rise or fall, depending on whether the connection is stimulatory or inhibitory.

The network connections between the molecular measurements in the data are "quantitative," partly because the network connections between the molecular measurements, as determined by the process, may be simulated in silico, based on the existing data set and the probabilistic measures associated therewith. For example, in the established network connections between the molecular measurements, it may be possible to theoretically increase or decrease (e.g., by 1, 2, 3, 5, 10, 20, 30, 50, 100-fold or more) the expression level of a given protein (or a "node" in the network), and quantitatively simulate its effects on other connected proteins in the network.

The network connections between the molecular measurements in the data are "unbiased," at least partly because no data points are statistically or artificially cut-off, and partly because the network connections are based on input data alone, without referring to pre-existing knowledge about the biological process in question.

The network connections between the molecular measurements in the data are "systemic" and (unbiased), partly because all potential connections among all input variables have been systemically explored, for example, in a pair-wise fashion. The reliance on computing power to execute such systemic probing exponentially increases as the number of input variables increases.

In general, an ensemble of ~1,000 networks is usually sufficient to predict probabilistic causal quantitative relationships among all of the measured entities. The ensemble of networks captures uncertainty in the data and enables the calculation of confidence metrics for each model prediction. Predictions generated using the ensemble of networks together, where differences in the predictions from individual networks in the ensemble represent the degree of uncertainty in the prediction. This feature enables the assignment of confidence metrics for predictions of clinical response generated from the model.

Once the models are reverse-engineered, further simulation queries may be conducted on the ensemble of models to determine key molecular drivers for the biological process in question, such as a disease condition.

Figure 9:
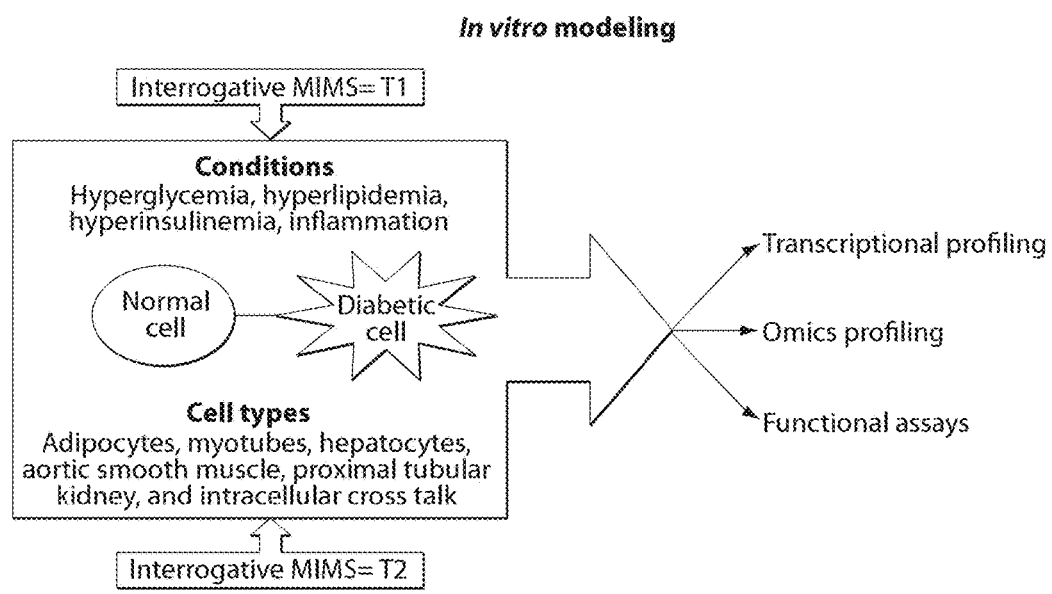
FIG. 9: Sketch of the components employed to build the In vitro models representing normal and diabetic states.
Figure 10:
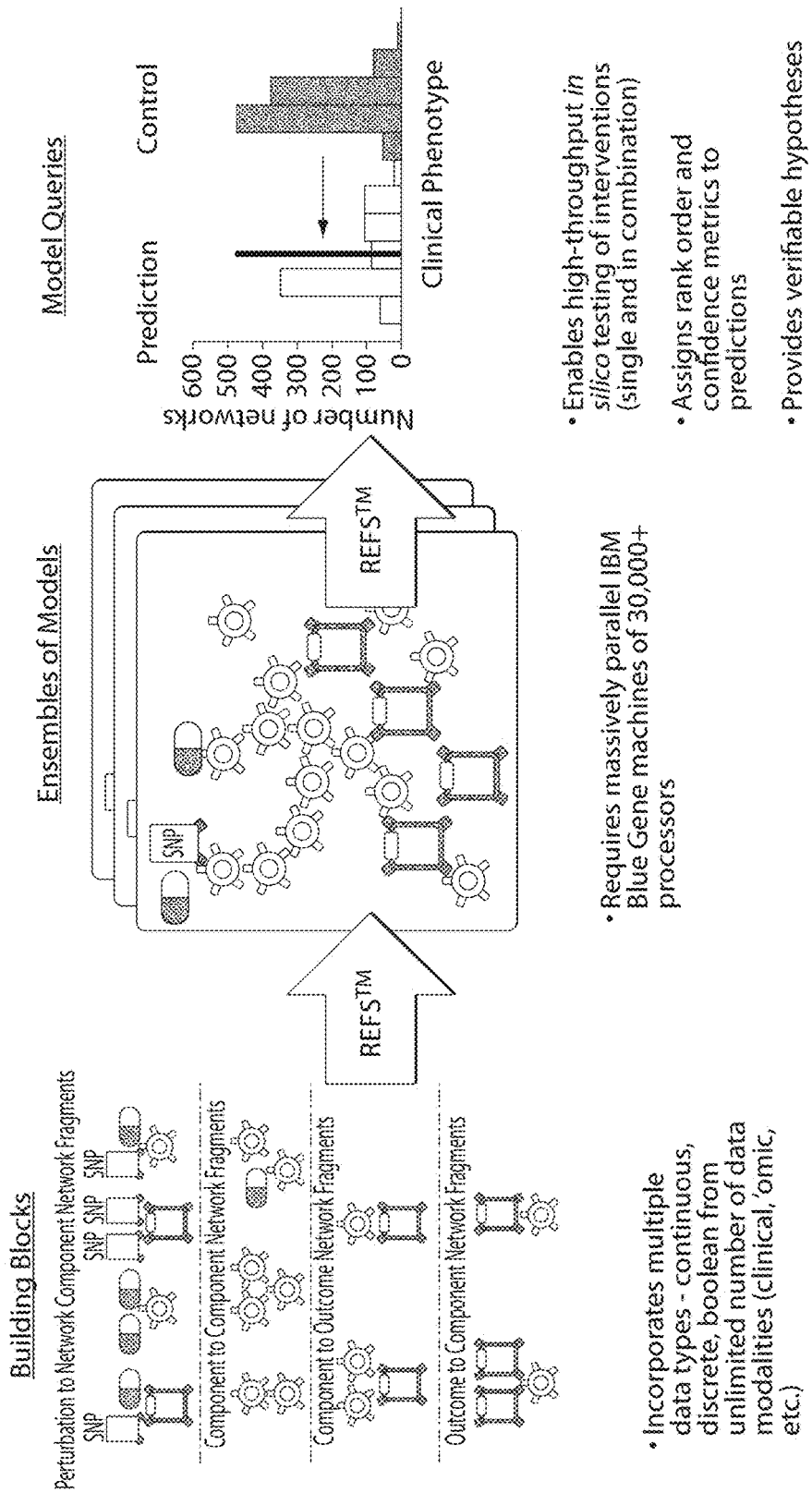
FIG. 10: Schematic representation of the informatics platform REFS™ used to generate causal networks of the protein as they relate to disease pathophysiology.
Figure 11:
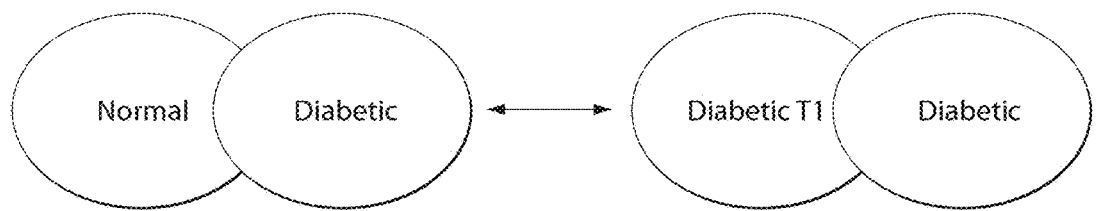
FIG. 11: Schematic representation of the approach towards generation of differential network in diabetic versus normal states and diabetic nodes that are restored to normal states by treatment with MIMS.
Figure 12:
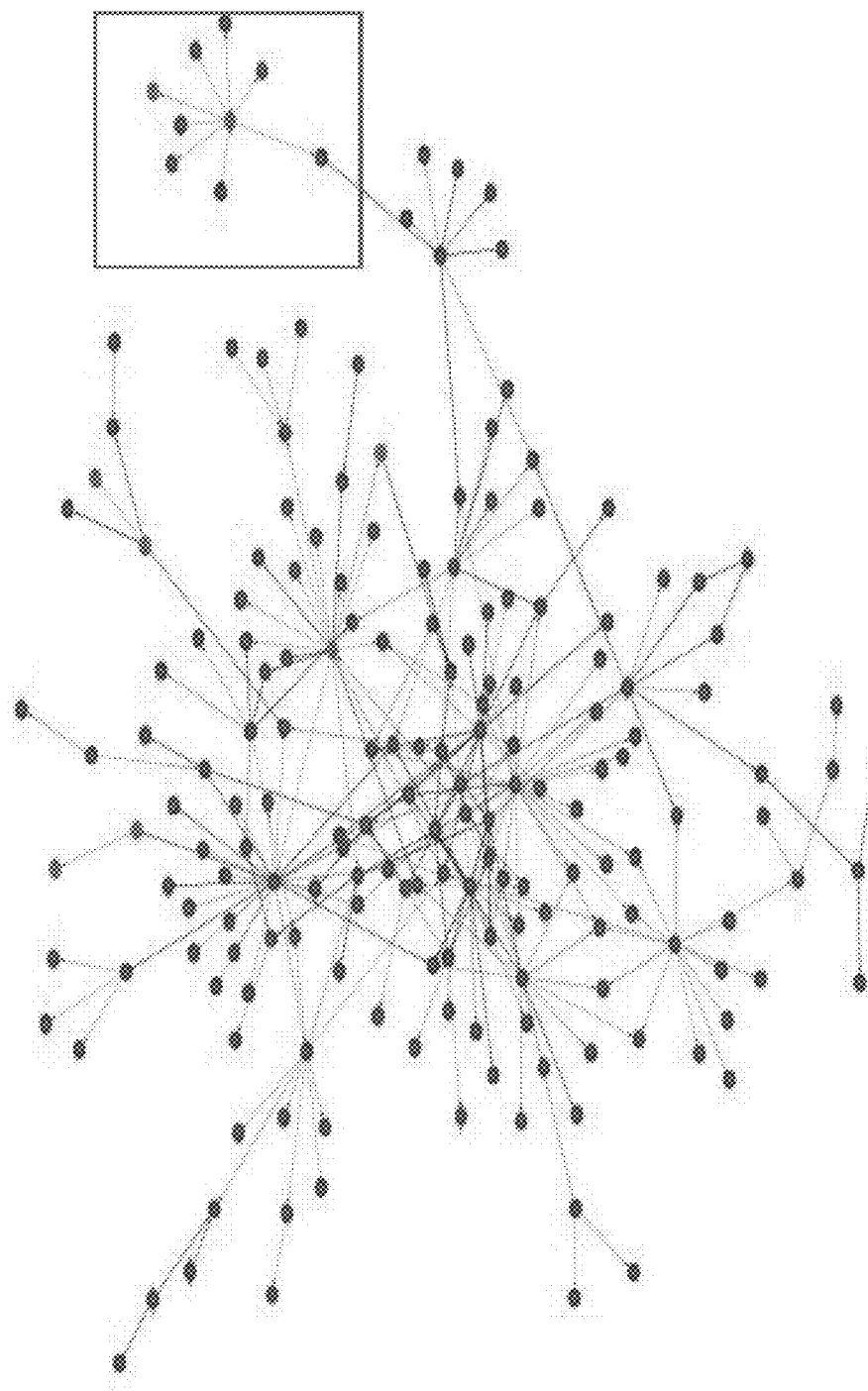
FIG. 12: A representative differential network in diabetic versus normal states.
Figure 13:
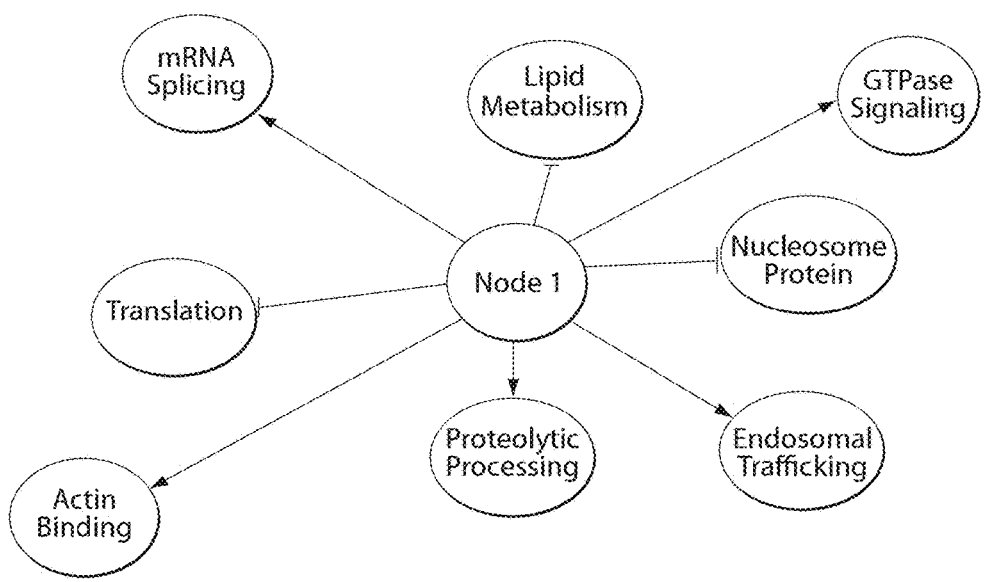
FIG. 13: A schematic representation of a node and associated edges of interest (Node1 in the center). The cellular functionality associated with each edge is represented.

Sketch of components employed to build exemplary In vitro models representing normal and diabetic statesis is depicted in FIG. 9. Schematic representation of an exemplary informatics platform REFS™ used to generate causal networks of the protein as they relate to disease pathophysiology is depicted in FIG. 10. Schematic representation of exemplary approach towards generation of differential network in diabetic versus normal states and diabetic nodes that are restored to normal states by treatment with MIMS is depicted in FIG. 11. A representative differential network in diabetic versus normal states is depicted in FIG. 12. A schematic representation of a node and associated edges of interest (Node1 in the center) and the cellular functionality associated with each edge is depicted in FIG. 13.

The invention having been generally described above, the sections below provide more detailed description for various aspects or elements of the general invention, in conjunction with one or more specific biological systems that can be analyzed using the methods herein. It should be noted, however, the specific biological systems used for illustration purpose below are not limiting. To the contrary, it is intended that other distinct biological systems, including any alternatives, modifications, and equivalents thereof, may be analyzed similarly using the subject Platform technology.

II. Definitions

As used herein, certain terms intended to be specifically defined, but are not already defined in other sections of the specification, are defined herein.

The articles "a" and "an" are used herein to refer to one or to more than one (i.e., to at least one) of the grammatical object of the article. By way of example, "an element" means one element or more than one element.

The term "including" is used herein to mean, and is used interchangeably with, the phrase "including but not limited to."

The term "or" is used herein to mean, and is used interchangeably with, the term "and/or," unless context clearly indicates otherwise.

The term "such as" is used herein to mean, and is used interchangeably, with the phrase "such as but not limited to."

"Metabolic pathway" refers to a sequence of enzyme-mediated reactions that transform one compound to another and provide intermediates and energy for cellular functions. The metabolic pathway can be linear or cyclic or branched.

"Metabolic state" refers to the molecular content of a particular cellular, multicellular or tissue environment at a given point in time as measured by various chemical and biological indicators as they relate to a state of health or disease.

"Angiogenesis" refers to is the physiological process involving the growth of new blood vessels from pre-existing vessels. Angiogenesis includes at least the proliferation of vascular endothelial cells, the migration of vascular endothelial cells typically in response to chemotacitic agents, the degradation of extracellular matrix typically by matrix metalloprotease production, matrix metalloproteinase production, tube formation, vessel lumen formation, vessel sprouting, adhesion molecule expression typically integrin expression, and differentiation. Depending on the culture system (e.g., one dimensional vs. three dimensional) and the cell type, various aspects of angiogenesis can be observed in cells grown in vitro as well as in vivo. Angiogenic cells or cells exhibiting at least one characteristic of an angiogenic cell exhibit 1, 2, 3, 4, 5, 6, 7, 8, 9, or more characteristics set forth above. Modulators of angiogenesis increase or decrease at least one of the characteristics provided above. Angiogenesis is distinct from vasculogenesis which is the spontaneous formation of blood vessels or intussusception is the term for the formation of new blood vessels by the splitting of existing ones.

The term "microarray" refers to an array of distinct polynucleotides, oligonucleotides, polypeptides (e.g., antibodies) or peptides synthesized on a substrate, such as paper, nylon or other type of membrane, filter, chip, glass slide, or any other suitable solid support.

The terms "disorders" and "diseases" are used inclusively and refer to any deviation from the normal structure or function of any part, organ or system of the body (or any combination thereof). A specific disease is manifested by characteristic symptoms and signs, including biological, chemical and physical changes, and is often associated with a variety of other factors including, but not limited to, demographic, environmental, employment, genetic and medically historical factors. Certain characteristic signs, symptoms, and related factors can be quantitated through a variety of methods to yield important diagnostic information.

The term "expression" includes the process by which a polypeptide is produced from polynucleotides, such as DNA. The process may involves the transcription of a gene into mRNA and the translation of this mRNA into a polypeptide. Depending on the context in which it is used, "expression" may refer to the production of RNA, protein or both.

The terms "level of expression of a gene" or "gene expression level" refer to the level of mRNA, as well as pre-mRNA nascent transcript(s), transcript processing intermediates, mature mRNA(s) and degradation products, or the level of protein, encoded by the gene in the cell.

The term "modulation" refers to upregulation (i.e., activation or stimulation), downregulation (i.e., inhibition or suppression) of a response, or the two in combination or apart. A "modulator" is a compound or molecule that modulates, and may be, e.g., an agonist, antagonist, activator, stimulator, suppressor, or inhibitor.

The phrase "affects the modulator" is understood as altering the expression of, altering the level of, or altering the activity of the modulator.

The term "Trolamine," as used herein, refers to Trolamine NF, Triethanolamine, TEALAN®, TEAlan 99%, Triethanolamine, 99%, Triethanolamine, NF or Triethanolamine, 99%, NF. These terms may be used interchangeably herein.

The term "genome" refers to the entirety of a biological entity's (cell, tissue, organ, system, organism) genetic information. It is encoded either in DNA or RNA (in certain viruses, for example). The genome includes both the genes and the non-coding sequences of the DNA.

The term "proteome" refers to the entire set of proteins expressed by a genome, a cell, a tissue, or an organism at a given time. More specifically, it may refer to the entire set of expressed proteins in a given type of cells or an organism at a given time under defined conditions. Proteome may include protein variants due to, for example, alternative splicing of genes and/or post-translational modifications (such as glycosylation or phosphorylation).

The term "transcriptome" refers to the entire set of transcribed RNA molecules, including mRNA, rRNA, tRNA, microRNA, dicer substrate RNAs, and other non-coding RNA produced in one or a population of cells at a given time. The term can be applied to the total set of transcripts in a given organism, or to the specific subset of transcripts present in a particular cell type. Unlike the genome, which is roughly fixed for a given cell line (excluding mutations), the transcriptome can vary with external environmental conditions. Because it includes all mRNA transcripts in the cell, the transcriptome reflects the genes that are being actively expressed at any given time, with the exception of mRNA degradation phenomena such as transcriptional attenuation.

The study of transcriptomics, also referred to as expression profiling, examines the expression level of mRNAs in a given cell population, often using high-throughput techniques based on DNA microarray technology.

The term "metabolome" refers to the complete set of small-molecule metabolites (such as metabolic intermediates, hormones and other signalling molecules, and secondary metabolites) to be found within a biological sample, such as a single organism, at a given time under a given condition. The metabolome is dynamic, and may change from second to second.

The term "lipidome" refers to the complete set of lipids to be found within a biological sample, such as a single organism, at a given time under a given condition. The lipidome is dynamic, and may change from second to second.

The term "interactome" refers to the whole set of molecular interactions in a biological system under study (e.g., cells). It can be displayed as a directed graph. Molecular interactions can occur between molecules belonging to different biochemical families (proteins, nucleic acids, lipids, carbohydrates, etc.) and also within a given family. When spoken in terms of proteomics, interactome refers to protein-protein interaction network (PPI), or protein interaction network (PIN). Another extensively studied type of interactome is the protein-DNA interactome (network formed by transcription factors (and DNA or chromatin regulatory proteins) and their target genes.

The term "cellular output" includes a collection of parameters, preferably measurable parameters, relating to cellullar status, including (without limiting): level of transcription for one or more genes (e.g., measurable by RT-PCR, qPCR, microarray, etc.), level of expression for one or more proteins (e.g., measurable by mass spectrometry or Western blot), absolute activity (e.g., measurable as substrate conversion rates) or relative activity (e.g., measurable as a % value compared to maximum activity) of one or more enzymes or proteins, level of one or more metabolites or intermediates, level of oxidative phosphorylation (e.g., measurable by Oxygen Consumption Rate or OCR), level of glycolysis (e.g., measurable by Extra Cellular Acidification Rate or ECAR), extent of ligand-target binding or interaction, activity of extracellular secreted molecules, etc. The cellular output may include data for a pre-determined number of target genes or proteins, etc., or may include a global assessment for all detectable genes or proteins. For example, mass spectrometry may be used to identify and/or quantitate all detectable proteins expressed in a given sample or cell population, without prior knowledge as to whether any specific protein may be expressed in the sample or cell population.

As used herein, a "cell system" includes a population of homogeneous or heterogeneous cells. The cells within the system may be growing in vivo, under the natural or physiological environment, or may be growing in vitro in, for example, controlled tissue culture environments. The cells within the system may be relatively homogeneous (e.g., no less than 70%, 80%, 90%, 95%, 99%, 99.5%, 99.9% homogeneous), or may contain two or more cell types, such as cell types usually found to grow in close proximity in vivo, or cell types that may interact with one another in vivo through, e.g., paracrine or other long distance inter-cellular communication. The cells within the cell system may be derived from established cell lines, including cancer cell lines, immortal cell lines, or normal cell lines, or may be primary cells or cells freshly isolated from live tissues or organs.

Cells in the cell system are typically in contact with a "cellular environment" that may provide nutrients, gases (oxygen or $CO_2$, etc.), chemicals, or proteinaceous/non-proteinaceous stimulants that may define the conditions that affect cellular behavior. The cellular environment may be a chemical media with defined chemical components and/or less well-defined tissue extracts or serum components, and may include a specific pH, $CO_2$ content, pressure, and temperature under which the cells grow. Alternatively, the cellular environment may be the natural or physiological environment found in vivo for the specific cell system.

In certain embodiments, a cell environment comprises conditions that simulate an aspect of a biological system or process, e.g., simulate a disease state, process, or environment. Such culture conditions include, for example, hyperglycemia, hypoxia, or lactic-rich conditions. Numerous other such conditions are described herein.

In certain embodiments, a cellular environment for a specific cell system also include certain cell surface features of the cell system, such as the types of receptors or ligands on the cell surface and their respective activities, the structure of carbohydrate or lipid molecules, membrane polarity or fluidity, status of clustering of certain membrane proteins, etc. These cell surface features may affect the function of nearby cells, such as cells belonging to a different cell system. In certain other embodiments, however, the cellular environment of a cell system does not include cell surface features of the cell system.

The cellular environment may be altered to become a "modified cellular environment." Alterations may include changes (e.g., increase or decrease) in any one or more component found in the cellular environment, including addition of one or more "external stimulus component" to the cellular environment. The environmental perturbation or external stimulus component may be endogenous to the cellular environment (e.g., the cellular environment contains some levels of the stimulant, and more of the same is added to increase its level), or may be exogenous to the cellular environment (e.g., the stimulant is largely absent from the cellular environment prior to the alteration). The cellular environment may further be altered by secondary changes resulting from adding the external stimulus component, since the external stimulus component may change the cellular output of the cell system, including molecules secreted into the cellular environment by the cell system.

As used herein, "external stimulus component", also referred to herein as "environmental perturbation", include any external physical and/or chemical stimulus that may affect cellular function. This may include any large or small organic or inorganic molecules, natural or synthetic chemicals, temperature shift, pH change, radiation, light (UVA, UVB etc.), microwave, sonic wave, electrical current, modulated or unmodulated magnetic fields, etc.

The term "Multidimensional Intracellular Molecule (MIM)", is an isolated version or synthetically produced version of an endogenous molecule that is naturally produced by the body and/or is present in at least one cell of a human. A MIM is capable of entering a cell and the entry into the cell includes complete or partial entry into the cell as long as the biologically active portion of the molecule wholly enters the cell. MIMs are capable of inducing a signal transduction and/or gene expression mechanism within a cell. MIMs are multidimensional because the molecules have both a therapeutic and a carrier, e.g., drug delivery, effect. MIMs also are multidimensional because the molecules act one way in a disease state and a different way in a normal state. For example, in the case of CoQ-10, administration of CoQ-10 to a melanoma cell in the presence of VEGF leads to a decreased level of Bcl2 which, in turn, leads to a decreased oncogenic potential for the melanoma cell. In contrast, in a normal fibroblast, co-administration of CoQ-10 and VEFG has no effect on the levels of Bcl2.

In one embodiment, a MIM is also an epi-shifter In another embodiment, a MIM is not an epi-shifter. In another embodiment, a MIM is characterized by one or more of the foregoing functions. In another embodiment, a MIM is characterized by two or more of the foregoing functions. In a further embodiment, a MIM is characterized by three or more of the foregoing functions. In yet another embodiment, a MIM is characterized by all of the foregoing functions. The skilled artisan will appreciate that a MIM of the invention is also intended to encompass a mixture of two or more endogenous molecules, wherein the mixture is characterized by one or more of the foregoing functions. The endogenous molecules in the mixture are present at a ratio such that the mixture functions as a MIM.

MIMs can be lipid based or non-lipid based molecules. Examples of MIMs include, but are not limited to, CoQ10, acetyl Co-A, palmityl Co-A, L-carnitine, amino acids such as, for example, tyrosine, phenylalanine, and cysteine. In one embodiment, the MIM is a small molecule. In one embodiment of the invention, the MIM is not CoQ10. MIMs can be routinely identified by one of skill in the art using any of the assays described in detail herein. MIMs are described in further detail in U.S. Ser. No. 12/777,902 (US 2011-0110914), the entire contents of which are expressly incorporated herein by reference.

As used herein, an "epimetabolic shifter" (epi-shifter) is a molecule that modulates the metabolic shift from a healthy (or normal) state to a disease state and vice versa, thereby maintaining or reestablishing cellular, tissue, organ, system and/or host health in a human. Epi-shifters are capable of effectuating normalization in a tissue microenvironment. For example, an epi-shifter includes any molecule which is capable, when added to or depleted from a cell, of affecting the microenvironment (e.g., the metabolic state) of a cell. The skilled artisan will appreciate that an epi-shifter of the invention is also intended to encompass a mixture of two or more molecules, wherein the mixture is characterized by one or more of the foregoing functions. The molecules in the mixture are present at a ratio such that the mixture functions as an epi-shifter. Examples of epi-shifters include, but are not limited to, CoQ-10; vitamin D3; ECM components such as fibronectin; immunomodulators, such as TNFa or any of the interleukins, e.g., IL-5, IL-12, IL-23; angiogenic factors; and apoptotic factors.

In one embodiment, the epi-shifter also is a MIM. In one embodiment, the epi-shifter is not CoQ10. Epi-shifters can be routinely identified by one of skill in the art using any of the assays described in detail herein. Epi-shifters are described in further detail in U.S. Ser. No. 12/777,902 (US 2011-0110914), the entire contents of which are expressly incorporated herein by reference.

Other terms not explicitly defined in the instant application have meaning as would have been understood by one of ordinary skill in the art.

III. Exemplary Steps and Components of the Platform Technology

For illustration purpose only, the following steps of the subject Platform Technology may be described herein below as an exemplary utility for integrating data obtained from a custom built cancer model, and for identifying novel proteins/pathways driving the pathogenesis of cancer. Relational maps resulting from this analysis provides cancer treatment targets, as well as diagnostic/prognostic markers associated with cancer. However, the subject Platform Technology has general applicability for any biological system or process, and is not limited to any particular cancer or other specific disease models.

In addition, although the description below is presented in some portions as discrete steps, it is for illustration purpose and simplicity, and thus, in reality, it does not imply such a rigid order and/or demarcation of steps. Moreover, the steps of the invention may be performed separately, and the invention provided herein is intended to encompass each of the individual steps separately, as well as combinations of one or more (e.g., any one, two, three, four, five, six or all seven steps) steps of the subject Platform Technology, which may be carried out independently of the remaining steps.

The invention also is intended to include all aspects of the Platform Technology as separate components and embodiments of the invention. For example, the generated data sets are intended to be embodiments of the invention. As further examples, the generated causal relationship networks, generated consensus causal relationship networks, and/or generated simulated causal relationship networks, are also intended to be embodiments of the invention. The causal relationships identified as being unique in the biological system are intended to be embodiments of the invention. Further, the custom built models for a particular biological system are also intended to be embodiments of the invention. For example, custom built models for a disease state or process, such as, e.g., models for angiogenesis, cell models for cancer, obesity/diabetes/cardiovascular disease, or a custom built model for toxicity (e.g., cardiotoxicity) of a drug, are also intended to be embodiments of the invention.

A. Custom Model Building

The first step in the Platform Technology is the establishment of a model for a biological system or process.

1. Angiogenesis Models

Both in vitro and in vivo models of angiogenesis are known. For example, an in vitro model using human umbilical cord vascular endothelail cells (HUVECs) is provided in detail in the Examples. Briefly, when HUVECs are grown in sub-confluent cultures, they exhibit characteristics of angiogenic cells. When HUVECs are grown in confluent cultures, they do not exhibit characteristics of angiogenic cells. Most steps in the angiogenic cascade can be analyzed in vitro, including endothelial cell proliferation, migration and differentiation. The proliferation studies are based on cell counting, thymidine incorporation, or immuno histochemical staining for cell proliferation (by measurement of PCNA) or cell death (by terminal deoxynucleotidyl transferase-mediated dUTP nick end labeling or Tunel assay). Chemotaxis can be examined in a Boyden chamber, which consists of an upper and lower well separated by a membrane filter. Chemotactic solutions are placed in the lower well, cells are added to the top well, and after a period of incubation the cells that have migrated toward the chemotactic stimulus are counted on the lower surface of the membrane. Cell migration can also be studied using the "scratch" assay provided in the Examples below. Differentiation can be induced in vitro by culturing endothelial cells in different ECM components, including two- and three-dimensional fibrin clots, collagen gels and matrigel. Microvessels have also been shown to grow from rings of rat aorta embedded in a three dimensional fibrin gel. Matrix metalloprotease expression can be assayed by zymogen assay.

Retinal vasculature is not fully formed in mice at the time of birth. Vascular growth and angiogenesis have been studied in detail in this model. Staged retina can be used to analyze angiogenesis as a normal biological process.

The chick chorioallantoic membrane (CAM) assay is well known in the art. The early chick embryo lacks a mature immune system and is therefore used to study tumor-induced angiogenesis. Tissue grafts are placed on the CAM through a window made in the eggshell. This caused a typical radial rearrangement of vessels towards, and a clear increase of vessels around the graft within four days after implantation. Blood vessels entering the graft are counted under a stereomicroscope. To assess the anti-angiogenic or angiogenic activity of test substances, the compounds are either prepared in slow release polymer pellets, absorbed by gelatin sponges or air-dried on plastic discs and then implanted onto the CAM. Several variants of the CAM assay including culturing of shell-less embryos in Petri dishes, and different quantification methods (i.e. measuring the rate of basement membrane biosynthesis using radio-labeled pro-line, counting the number of vessels under a microscope or image analysis) have been described.

The cornea presents an in vivo avascular site. Therefore, any vessels penetrating from the limbus into the corneal stroma can be identified as newly formed. To induce an angiogenic response, slow release polymer pellets [i.e. poly-2-hydroxyethyl-methacrylate (hydron) or ethylene-vinyl acetate copolymer (ELVAX)], containing an angiogenic substance (i.e. FGF-2 of VEGF) are implanted in "pockets" created in the corneal stroma of a rabbit. Also, a wide variety of tissues, cells, cell extracts and conditioned media have been examined for their effect on angiogenesis in the cornea. The vascular response can be quantified by computer image analysis after perfusion of the cornea with India ink. Cornea can be harvested and analyzed using the platform methods provided herein.

MATRIGEL® is a matrix of a mouse basement membrane neoplasm known as Engelbreth-Holm-Swarm murine sarcoma. It is a complex mixture of basement membrane proteins including laminin, collagen type IV, heparan sulfate, fibrin and growth factors, including EGF, TGF-b, PDGF and IGF-1. It was originally developed to study endothelial cell differentiation in vitro. However, MATRIGEL®-containing FGF-2 can be injected subcutaneously in mice. MATRIGEL® is liquid at 4° C. but forms a solid gel at 37° C. that traps the growth factor to allow its slow release. Typically, after 10 days, the MATRIGEL® plugs are removed and angiogenesis is quantified histologically or morphometrically in plug sections. MATRIGEL® plugs can be harvested and analyzed using the platform methods provided herein.

2. In Vitro Disease Models

An example of a biological system or process is cancer. As any other complicated biological process or system, cancer is a complicated pathological condition characterized by multiple unique aspects. For example, due to its high growth rate, many cancer cells are adapted to grow in hypoxia conditions, have up-regulated glycolysis and reduced oxidative phosphorylation metabolic pathways. As a result, cancer cells may react differently to an environmental perturbation, such as treatment by a potential drug, as compared to the reaction by a normal cell in response to the same treatment. Thus, it would be of interest to decipher cancer's unique responses to drug treatment as compared to the responses of normal cells. To this end, a custom cancer model may be established to simulate the environment of a cancer cell, e.g., within a tumor in vivo, by creating cell culture conditions closely approximating the conditions of a cancer cell in a tumor in vivo, or to mimic various aspects of cancer growth, by isolating different growth conditions of the cancer cells.

One such cancer "environment", or growth stress condition, is hypoxia, a condition typically found within a solid tumor. Hypoxia can be induced in cells in cells using art-recognized methods. For example, hypoxia can be induced by placing cell systems in a Modular Incubator Chamber (MIC-101, Billups-Rothenberg Inc. Del Mar, Calif.), which can be flooded with an industrial gas mix containing 5% $CO_2$, 2% $O_2$ and 93% nitrogen. Effects can be measured after a pre-determined period, e.g., at 24 hours after hypoxia treatment, with and without additional external stimulus components (e.g., CoQ10 at 0, 50, or 100 μM).

Likewise, lactic acid treatment of cells mimics a cellular environment where glycolysis activity is high, as exists in the tumor environment in vivo. Lactic acid induced stress can be investigated at a final lactic acid concentration of about 12.5 mM at a pre-determined time, e.g., at 24 hours, with or without additional external stimulus components (e.g., CoQ10 at 0, 50, or 100 μM).

Hyperglycemia is normally a condition found in diabetes; however, hyperglycemia also to some extent mimics one aspect of cancer growth because many cancer cells rely on glucose as their primary source of energy. Exposing subject cells to a typical hyperglycemic condition may include adding 10% culture grade glucose to suitable media, such that the final concentration of glucose in the media is about 22 mM.

Individual conditions reflecting different aspects of cancer growth may be investigated separately in the custom built cancer model, and/or may be combined together. In one embodiment, combinations of at least 2, 3, 4, 5, 6, 7, 8, 9, 10, 15, 20, 25, 30, 40, 50 or more conditions reflecting or simulating different aspects of cancer growth/conditions are investigated in the custom built cancer model. In one embodiment, individual conditions and, in addition, combinations of at least 2, 3, 4, 5, 6, 7, 8, 9, 10, 15, 20, 25, 30, 40, 50 or more of the conditions reflecting or simulating different aspects of cancer growth/conditions are investigated in the custom built cancer model. All values presented in the foregoing list can also be the upper or lower limit of ranges, that are intended to be a part of this invention, e.g., between 1 and 5, 1 and 10, 1 and 20, 1 and 30, 2 and 5, 2 and 10, 5 and 10, 1 and 20, 5 and 20, 10 and 20, 10 and 25, 10 and 30 or 10 and 50 different conditions.

Listed herein below are a few exemplary combinations of conditions that can be used to treat cells. Other combinations can be readily formulated depending on the specific interrogative biological assessment that is being conducted.

1. Media only
2. 50 µM CTL Coenzyme Q10 (CoQ10)
3. 100 µM CTL Coenzyme Q10
4. 12.5 mM Lactic Acid
5. 12.5 mM Lactic Acid+50 µM CTL Coenzyme Q10
6. 12.5 mM Lactic Acid+100 µM CTL Coenzyme Q10
7. Hypoxia
8. Hypoxia+50 µM CTL Coenzyme Q10
9. Hypoxia+100 µM CTL Coenzyme Q10
10. Hypoxia+12.5 mM Lactic Acid
11. Hypoxia+12.5 mM Lactic Acid+50 µM CTL Coenzyme Q10
12. Hypoxia+12.5 mM Lactic Acid+100 µM CTL Coenzyme Q10
13. Media+22 mM Glucose
14. 50 µM CTL Coenzyme Q10+22 mM Glucose
15. 100 µM CTL Coenzyme Q10+22 mM Glucose
16. 12.5 mM Lactic Acid+22 mM Glucose
17. 12.5 mM Lactic Acid+22 mM Glucose+50 µM CTL Coenzyme Q10
18. 12.5 mM Lactic Acid+22 mM Glucose+100 µM CTL Coenzyme Q10
19. Hypoxia+22 mM Glucose
20. Hypoxia+22 mM Glucose+50 µM CTL Coenzyme Q10
21. Hypoxia+22 mM Glucose+100 µM CTL Coenzyme Q10
22. Hypoxia+12.5 mM Lactic Acid+22 mM Glucose
23. Hypoxia+12.5 mM Lactic Acid+22 mM Glucose+50 µM CTL Coenzyme Q10
24. Hypoxia+12.5 mM Lactic Acid+22 mM Glucose+100 µM CTL Coenzyme Q10

As a control one or more normal cell lines (e.g., THLE2 and HDFa) are cultured under similar conditions in order to identify cancer unique proteins or pathways (see below). The control may be the comparison cell model described above.

Multiple cancer cells of the same or different origin (for example, cancer lines PaCa2, HepG2, PC3 and MCF7), as opposed to a single cancer cell type, may be included in the cancer model. In certain situations, cross talk or ECS experiments between different cancer cells (e.g., HepG2 and PaCa2) may be conducted for several inter-related purposes.

In some embodiments that involve cross talk, experiments conducted on the cell models are designed to determine modulation of cellular state or function of one cell system or population (e.g., Hepatocarcinoma cell HepG2) by another cell system or population (e.g., Pancreatic cancer PaCa2) under defined treatment conditions (e.g., hyperglycemia, hypoxia (ischemia)). According to a typical setting, a first cell system/population is contacted by an external stimulus components, such as a candidate molecule (e.g., a small drug molecule, a protein) or a candidate condition (e.g., hypoxia, high glucose environment). In response, the first cell system/population changes its transcriptome, proteome, metabolome, and/or interactome, leading to changes that can be readily detected both inside and outside the cell. For example, changes in transcriptome can be measured by the transcription level of a plurality of target mRNAs; changes in proteome can be measured by the expression level of a plurality of target proteins; and changes in metabolome can be measured by the level of a plurality of target metabolites by assays designed specifically for given metabolites. Alternatively, the above referenced changes in metabolome and/or proteome, at least with respect to certain secreted metabolites or proteins, can also be measured by their effects on the second cell system/population, including the modulation of the transcriptome, proteome, metabolome, and interactome of the second cell system/population. Therefore, the experiments can be used to identify the effects of the molecule(s) of interest secreted by the first cell system/population on a second cell system/population under different treatment conditions. The experiments can also be used to identify any proteins that are modulated as a result of signaling from the first cell system (in response to the external stimulus component treatment) to another cell system, by, for example, differential screening of proteomics. The same experimental setting can also be adapted for a reverse setting, such that reciprocal effects between the two cell systems can also be assessed. In general, for this type of experiment, the choice of cell line pairs is largely based on the factors such as origin, disease state and cellular function.

Although two-cell systems are typically involved in this type of experimental setting, similar experiments can also be designed for more than two cell systems by, for example, immobilizing each distinct cell system on a separate solid support.

Once the custom model is built, one or more "perturbations" may be applied to the system, such as genetic variation from patient to patient, or with/without treatment by certain drugs or pro-drugs. See FIG. 15D. The effects of such perturbations to the system, including the effect on disease related cancer cells, and disease related normal control cells, can be measured using various art-recognized or proprietary means, as described in section III.B below.

In an exemplary experiment, cancer lines PaCa2, HepG2, PC3 and MCF7, and normal cell lines THLE2 and HDFa, are conditioned in each of hyperglycemia, hypoxia, and lactic acid-rich conditions, as well as in all combinations of two or three of three conditions, and in addition with or without an environmental perturbation, specifically treatment by CoenzymeQ10.

The custom built cell model may be established and used throughout the steps of the Platform Technology of the invention to ultimately identify a causal relationship unique in the biological system, by carrying out the steps described herein. It will be understood by the skilled artisan, however, that a custom built cell model that is used to generate an initial, "first generation" consensus causal relationship network for a biological process can continually evolve or expand over time, e.g., by the introduction of additional cancer or normal cell lines and/or additional cancer conditions. Additional data from the evolved cell model, i.e., data from the newly added portion(s) of the cell model, can be collected. The new data collected from an expanded or evolved cell model, i.e., from newly added portion(s) of the cell model, can then be introduced to the data sets previously used to generate the "first generation" consensus causal relationship network in order to generate a more robust "second generation" consensus causal relationship network. New causal relationships unique to the biological system can then be identified from the "second generation" consensus causal relationship network. In this way, the evolution of the cell model provides an evolution of the consensus causal relationship networks, thereby providing new and/or more reliable insights into the modulators of the biological system.

Additional examples of custom built cell models are described in detail herein.

B. Data Collection

In general, two types of data may be collected from any custom built model systems. One type of data (e.g., the first set of data, the third set of data) usually relates to the level of certain macromolecules, such as DNA, RNA, protein, lipid, etc. An exemplary data set in this category is proteomic data (e.g., qualitative and quantitative data concerning the expression of all or substantially all measurable proteins from a sample). The other type of data is generally functional data (e.g., the second set of data, the fourth set of data) that reflects the phenotypic changes resulting from the changes in the first type of data.

With respect to the first type of data, in some example embodiments, quantitative polymerase chain reaction (qPCR) and proteomics are performed to profile changes in cellular mRNA and protein expression by quantitative polymerase chain reaction (qPCR) and proteomics. Total RNA can be isolated using a commercial RNA isolation kit. Following cDNA synthesis, specific commercially available qPCR arrays (e.g., those from SA Biosciences) for disease area or cellular processes such as angiogenesis, apoptosis, and diabetes, may be employed to profile a predetermined set of genes by following a manufacturer's instructions. For example, the Biorad cfx-384 amplification system can be used for all transcriptional profiling experiments. Following data collection (Ct), the final fold change over control can be determined using the δCt method as outlined in manufacturer's protocol. Proteomic sample analysis can be performed as described in subsequent sections.

The subject method may employ large-scale high-throughput quantitative proteomic analysis of hundreds of samples of similar character, and provides the data necessary for identifying the cellular output differentials.

There are numerous art-recognized technologies suitable for this purpose. An exemplary technique, iTRAQ analysis in combination with mass spectrometry, is briefly described below.

The quantitative proteomics approach is based on stable isotope labeling with the 8-plex iTRAQ reagent and 2D-LC MALDI MS/MS for peptide identification and quantification. Quantification with this technique is relative: peptides and proteins are assigned abundance ratios relative to a reference sample. Common reference samples in multiple iTRAQ experiments facilitate the comparison of samples across multiple iTRAQ experiments.

For example, to implement this analysis scheme, six primary samples and two control pool samples can be combined into one 8-plex iTRAQ mix according to the manufacturer's suggestions. This mixture of eight samples then can be fractionated by two-dimensional liquid chromatography; strong cation exchange (SCX) in the first dimension, and reversed-phase HPLC in the second dimension, then can be subjected to mass spectrometric analysis.

A brief overview of exemplary laboratory procedures that can be employed is provided herein.

Protein Extraction:

Cells can be lysed with 8 M urea lysis buffer with protease inhibitors (Thermo Scientific Halt Protease inhibitor EDTA-free) and incubate on ice for 30 minutes with vertex for 5 seconds every 10 minutes. Lysis can be completed by ultrasonication in 5 seconds pulse. Cell lysates can be centrifuged at 14000×g for 15 minutes (4° C.) to remove cellular debris. Bradford assay can be performed to determine the protein concentration. 100 ug protein from each samples can be reduced (10 mM Dithiothreitol (DTT), 55° C., 1 h), alkylated (25 mM iodoacetamide, room temperature, 30 minutes) and digested with Trypsin (1:25 w/w, 200 mM triethylammonium bicarbonate (TEAB), 37° C., 16 h).

Secretome Sample Preparation:

1) In one embodiment, the cells can be cultured in serum free medium: Conditioned media can be concentrated by freeze dryer, reduced (10 mM Dithiothreitol (DTT), 55° C., 1 h), alkylated (25 mM iodoacetamide, at room temperature, incubate for 30 minutes), and then desalted by actone precipitation. Equal amount of proteins from the concentrated conditioned media can be digested with Trypsin (1:25 w/w, 200 mM triethylammonium bicarbonate (TEAB), 37° C., 16 h).

In one embodiment, the cells can be cultured in serum containing medium: The volume of the medium can be reduced using 3k MWCO Vivaspin columns (GE Healthcare Life Sciences), then can be reconstituted with 1×PBS (Invitrogen). Serum albumin can be depleted from all samples using AlbuVoid column (Biotech Support Group, LLC) following the manufacturer's instructions with the modifications of buffer-exchange to optimize for condition medium application.

iTRAQ 8 Plex Labeling:

Aliquot from each tryptic digests in each experimental set can be pooled together to create the pooled control sample. Equal aliquots from each sample and the pooled control sample can be labeled by iTRAQ 8 Plex reagents according to the manufacturer's protocols (AB Sciex). The reactions can be combined, vacuumed to dryness, re-suspended by adding 0.1% formic acid, and analyzed by LC-MS/MS.

2D-NanoLC-MS/MS:

All labeled peptides mixtures can be separated by online 2D-nanoLC and analysed by electrospray tandem mass spectrometry. The experiments can be carried out on an Eksigent 2D NanoLC Ultra system connected to an LTQ Orbitrap Velos mass spectrometer equipped with a nano-electrospray ion source (Thermo Electron, Bremen, Germany).

The peptides mixtures can be injected into a 5 cm SCX column (300 μm ID, 5 μm, PolySULFOETHYL Aspartamide column from PolyLC, Columbia, Md.) with a flow of 4 μL/min and eluted in 10 ion exchange elution segments into a C18 trap column (2.5 cm, 100 μm ID, 5 μm, 300 Å ProteoPep II from New Objective, Woburn, Mass.) and washed for 5 mM with H2O/0.1% FA. The separation then can be further carried out at 300 mL/min using a gradient of 2-45% B (H2O/0.1% FA (solvent A) and ACN/0.1% FA (solvent B)) for 120 minutes on a 15 cm fused silica column (75 μm ID, 5 μm, 300 Å ProteoPep II from New Objective, Woburn, Mass.).

Full scan MS spectra (m/z 300-2000) can be acquired in the Orbitrap with resolution of 30,000. The most intense ions (up to 10) can be sequentially isolated for fragmentation using High energy C-trap Dissociation (HCD) and dynamically exclude for 30 seconds. HCD can be conducted with an isolation width of 1.2 Da. The resulting fragment ions can be scanned in the orbitrap with resolution of 7500. The LTQ Orbitrap Velos can be controlled by Xcalibur 2.1 with foundation 1.0.1.

Peptides/Proteins Identification and Quantification:

Peptides and proteins can be identified by automated database searching using Proteome Discoverer software (Thermo Electron) with Mascot search engine against SwissProt database. Search parameters can include 10 ppm for MS tolerance, 0.02 Da for MS2 tolerance, and full trypsin digestion allowing for up to 2 missed cleavages. Carbamidomethylation (C) can be set as the fixed modification. Oxidation (M), TMT6, and deamidation (NQ) can be set as dynamic modifications. Peptides and protein identifications can be filtered with Mascot Significant Threshold (p<0.05). The filters can be allowed a 99% confidence level of protein identification (1% FDA).

The Proteome Discoverer software can apply correction factors on the reporter ions, and can reject all quantitation values if not all quantitation channels are present. Relative protein quantitation can be achieved by normalization at the mean intensity.

With respect to the second type of data, in some exemplary embodiments, bioenergetics profiling of cancer and normal models may employ the Seahorse™ XF24 analyzer to enable the understanding of glycolysis and oxidative phosphorylation components.

Specifically, cells can be plated on Seahorse culture plates at optimal densities. These cells can be plated in 100 µl of media or treatment and left in a 37° C. incubator with 5% $CO_2$. Two hours later, when the cells are adhered to the 24 well plate, an additional 150 µl of either media or treatment solution can be added and the plates can be left in the culture incubator overnight. This two step seeding procedure allows for even distribution of cells in the culture plate. Seahorse cartridges that contain the oxygen and pH sensor can be hydrated overnight in the calibrating fluid in a non-$CO_2$ incubator at 37° C. Three mitochondrial drugs are typically loaded onto three ports in the cartridge. Oligomycin, a complex III inhibitor, FCCP, an uncoupler and Rotenone, a complex I inhibitor can be loaded into ports A, B and C respectively of the cartridge. All stock drugs can be prepared at a 10× concentration in an unbuffered DMEM media. The cartridges can be first incubated with the mitochondrial compounds in a non-$CO_2$ incubator for about 15 minutes prior to the assay. Seahorse culture plates can be washed in DMEM based unbuffered media that contains glucose at a concentration found in the normal growth media. The cells can be layered with 630 ul of the unbuffered media and can be equilibriated in a non-$CO_2$ incubator before placing in the Seahorse instrument with a precalibrated cartridge. The instrument can be run for three-four loops with a mix, wait and measure cycle for get a baseline, before injection of drugs through the port is initiated. There can be two loops before the next drug is introduced.

OCR (Oxygen consumption rate) and ECAR (Extracullular Acidification Rate) can be recorded by the electrodes in a 7 µl chamber and can be created with the cartridge pushing against the seahorse culture plate.

C. Data Integration and in Silico Model Generation

Once relevant data sets have been obtained, integration of data sets and generation of computer-implemented statistical models may be performed using an AI-based informatics system or platform (e.g, the REFS™ platform). For example, an exemplary AI-based system may produce simulation-based networks of protein associations as key drivers of metabolic end points (ECAR/OCR). See FIG. 15. Some background details regarding the REFS™ system may be found in Xing et al., "Causal Modeling Using Network Ensemble Simulations of Genetic and Gene Expression Data Predicts Genes Involved in Rheumatoid Arthritis," *PLoS Computational Biology*, vol. 7, issue. 3, 1-19 (March 2011) (e100105) and U.S. Pat. No. 7,512,497 to Periwal, the entire contents of each of which is expressly incorporated herein by reference in its entirety. In essence, as described earlier, the REFS™ system is an AI-based system that employs mathematical algorithms to establish causal relationships among the input variables (e.g., protein expression levels, mRNA expression levels, and the corresponding functional data, such as the OCR/ECAR values measured on Seahorse culture plates). This process is based only on the input data alone, without taking into consideration prior existing knowledge about any potential, established, and/or verified biological relationships.

In particular, a significant advantage of the platform of the invention is that the AI-based system is based on the data sets obtained from the cell model, without resorting to or taking into consideration any existing knowledge in the art concerning the biological process. Further, preferably, no data points are statistically or artificially cut-off and, instead, all obtained data is fed into the AI-system for determining protein associations. Accordingly, the resulting statistical models generated from the platform are unbiased, since they do not take into consideration any known biological relationships.

Specifically, data from the proteomics and ECAR/OCR can be input into the AI-based information system, which builds statistical models based on data associations, as described above. Simulation-based networks of protein associations are then derived for each disease versus normal scenario, including treatments and conditions using the following methods.

Figure 16:
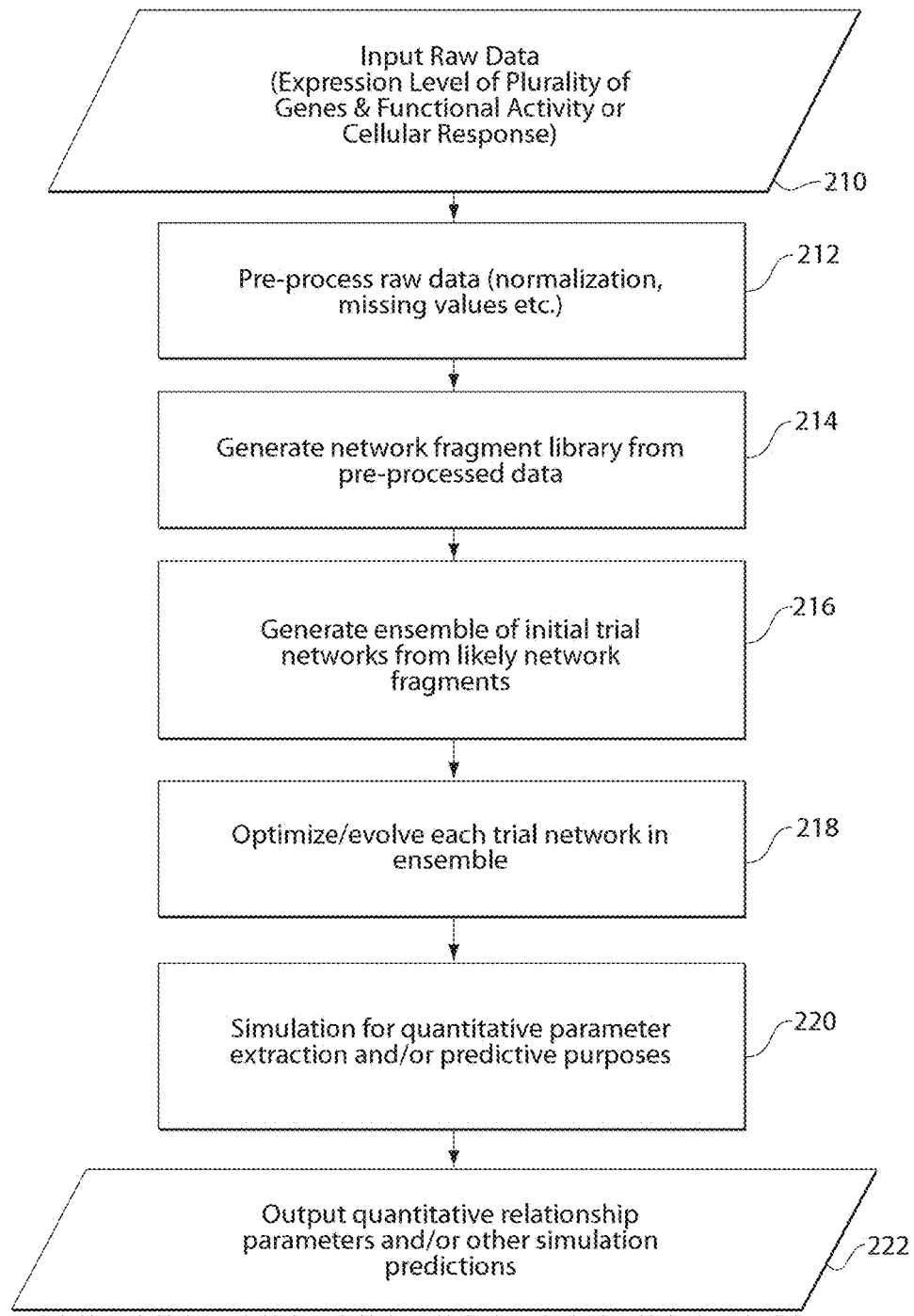
FIG. 16: Flow chart of process in AI-based informatics system that may be used with some exemplary embodiments.

A detailed description of an exemplary process for building the generated (e.g., optimized or evolved) networks appears below with respect to FIG. 16. As described above, data from the proteomics and functional cell data is input into the AI-based system (step 210). The input data, which may be raw data or minimally processed data, is pre-processed, which may include normalization (e.g., using a quantile function or internal standards) (step 212). The pre-processing may also include imputing missing data values (e.g., by using the K-nearest neighbor (K-NN) algorithm) (step 212).

The pre-processed data is used to construct a network fragment library (step 214). The network fragments define quantitative, continuous relationships among all possible small sets (e.g., 2-3 member sets or 2-4 member sets) of measured variables (input data). The relationships between the variables in a fragment may be linear, logistic, multinomial, dominant or recessive homozygous, etc. The relationship in each fragment is assigned a Bayesian probabilistic score that reflect how likely the candidate relationship is given the input data, and also penalizes the relationship for its mathematical complexity. By scoring all of the possible pairwise and three-way relationships (and in some embodiments also four-way relationships) inferred from the input data, the most likely fragments in the library can be identified (the likely fragments). Quantitative parameters of the relationship are also computed based on the input data and stored for each fragment. Various model types may be used in fragment enumeration including but not limited to linear regression, logistic regression, (Analysis of Variance) ANOVA models, (Analysis of Covariance) ANCOVA models, non-linear/polynomial regression models and even non-parametric regression. The prior assumptions on model parameters may assume Gull distributions or Bayesian Information Criterion (BIC) penalties related to the number of parameters used in the model. In a network inference process, each network in an ensemble of initial trial networks is constructed from a subset of fragments in the fragment library. Each initial trial network in the ensemble of initial trial networks is constructed with a different subset of the fragments from the fragment library (step 216).

An overview of the mathematical representations underlying the Bayesian networks and network fragments, which is based on Xing et al., "Causal Modeling Using Network Ensemble Simulations of Genetic and Gene Expression Data Predicts Genes Involved in Rheumatoid Arthritis," *PLoS Computational Biology*, vol. 7, issue. 3, 1-19 (March 2011) (e100105), is presented below.

A multivariate system with random variables $X=X_1,K,X_n$ be characterized by a multivariate probability distribution function $P(X_1,K,X_n;\Theta)$, that includes a large number of parameters Θ. The multivariate probability distribution function may be factorized and represented by a product of local conditional probability distributions:

$$P(X_1, \ldots, X_n; \Theta) = \prod_{i=1}^{n} P_i(X_i | Y_{j1}, \ldots, Y_{jK_i}; \Theta_i),$$

in which each variable $X_i$ is independent from its non-descendent variables given its $K_i$ parent variables, which are $Y_{j1}, \ldots, Y_{jK_i}$. After factorization, each local probability distribution has its own parameters $\Theta_i$.

The multivariate probability distribution function may be factorized in different ways with each particular factorization and corresponding parameters being a distinct probabilistic model. Each particular factorization (model) can be represented by a Directed Acrylic Graph (DAC) having a vertex for each variable $X_i$ and directed edges between vertices representing dependences between variables in the local conditional distributions $P_i(X_i | Y_{j1}, \ldots, Y_{jK_i})$. Subgraphs of a DAG, each including a vertex and associated directed edges are network fragments.

A model is evolved or optimized by determining the most likely factorization and the most likely parameters given the input data. This may be described as "learning a Bayesian network," or, in other words, given a training set of input data, finding a network that best matches the input data. This is accomplished by using a scoring function that evaluates each network with respect to the input data.

A Bayesian framework is used to determine the likelihood of a factorization given the input data. Bayes Law states that the posterior probability, P(D|M), of a model M, given data D is proportional to the product of the product of the posterior probability of the data given the model assumptions, P(D|M), multiplied by the prior probability of the model, P(M), assuming that the probability of the data, P(D), is constant across models. This is expressed in the following equation:

$$P(M|D) = \frac{P(D|M) * P(M)}{P(D)}.$$

The posterior probability of the data assuming the model is the integral of the data likelihood over the prior distribution of parameters:

$$P(D|M) = \int P(D|M(\Theta)) P(\Theta|M) d\Theta.$$

Assuming all models are equally likely (i.e., that P(M) is a constant), the posterior probability of model M given the data D may be factored into the product of integrals over parameters for each local network fragment $M_i$ as follows:

$$P(M|D) = \prod_{i=1}^{n} \int P_i(X_i | Y_{j1}, \ldots, Y_{jK_i}; \Theta_i).$$

Note that in the equation above, a leading constant term has been omitted. In some embodiments, a Bayesian Information Criterion (BIC), which takes a negative logarithm of the posterior probability of the model P(D|M) may be used to "Score" each model as follows:

$$S_{tot}(M) = -\log P(M|D) = \sum_{i=1}^{n} S(M_i),$$

where the total score $S_{tot}$ for a model M is a sum of the local scores $S_i$ for each local network fragment. The BIC further gives an expression for determining a score each individual network fragment:

$$S(M_i) \approx S_{BIC}(M_i) = S_{MLE}(M_i) + \frac{\kappa(M_i)}{2} \log N$$

where $\kappa(M_i)$ is the number of fitting parameter in model $M_i$ and N is the number of samples (data points). $S_{MLE}(M_i)$ is the negative logarithm of the likelihood function for a network fragment, which may be calculated from the functional relationships used for each network fragment. For a BIC score, the lower the score, the more likely a model fits the input data.

The ensemble of trial networks is globally optimized, which may be described as optimizing or evolving the networks (step 218). For example, the trial networks may be evolved and optimized according to a Metropolis Monte Carlo Sampling algorithm. Simulated annealing may be used to optimize or evolve each trial network in the ensemble through local transformations. In an example simulated annealing processes, each trial network is changed by adding a network fragment from the library, by deleted a network fragment from the trial network, by substituting a network fragment or by otherwise changing network topology, and then a new score for the network is calculated. Generally speaking, if the score improves, the change is kept and if the score worsens the change is rejected. A "temperature" parameter allows some local changes which worsen the score to be kept, which aids the optimization process in avoiding some local minima. The "temperature" parameter is decreased over time to allow the optimization/evolution process to converge.

All or part of the network inference process may be conducted in parallel for the trial different networks. Each network may be optimized in parallel on a separate processor and/or on a separate computing device. In some embodiments, the optimization process may be conducted on a supercomputer incorporating hundreds to thousands of processors which operate in parallel. Information may be shared among the optimization processes conducted on parallel processors.

The optimization process may include a network filter that drops any networks from the ensemble that fail to meet a threshold standard for overall score. The dropped network may be replaced by a new initial network. Further any networks that are not "scale free" may be dropped from the ensemble. After the ensemble of networks has been optimized or evolved, the result may be termed an ensemble of generated cell model networks, which may be collectively referred to as the generated consensus network.

D. Simulation to Extract Quantitative Relationship Information and for Prediction Simulation may be used to extract quantitative parameter information regarding each relationship in the generated cell model networks (step 220). For example, the simulation for quantitative information extraction may involve perturbing (increasing or decreasing) each node in the network by 10 fold and calculating the posterior distributions for the other nodes (e.g., proteins) in the models. The endpoints are compared by t-test with the assumption of 100 samples per group and the 0.01 significance cut-off. The t-test statistic is the median of 100 t-tests. Through use of this simulation technique, an AUC (area under the curve) representing the strength of prediction and fold change representing the in silico magnitude of a node driving an end point are generated for each relationship in the ensemble of networks.

A relationship quantification module of a local computer system may be employed to direct the AI-based system to perform the perturbations and to extract the AUC information and fold information. The extracted quantitative information may include fold change and AUC for each edge connecting a parent note to a child node. In some embodiments, a custom-built R program may be used to extract the quantitative information.

In some embodiments, the ensemble of generated cell model networks can be used through simulation to predict responses to changes in conditions, which may be later verified though wet-lab cell-based, or animal-based, experiments.

The output of the AI-based system may be quantitative relationship parameters and/or other simulation predictions (222).

E. Generation of Differential (Delta) Networks

A differential network creation module may be used to generate differential (delta) networks between generated cell model networks and generated comparison cell model networks. As described above, in some embodiments, the differential network compares all of the quantitative parameters of the relationships in the generated cell model networks and the generated comparison cell model network. The quantitative parameters for each relationship in the differential network are based on the comparison. In some embodiments, a differential may be performed between various differential networks, which may be termed a delta-delta network. An example of a delta-delta network is described below with respect to FIG. 26 in the Examples section. The differential network creation module may be a program or script written in PERL.

F. Visualization of Networks

The relationship values for the ensemble of networks and for the differential networks may be visualized using a network visualization program (e.g., Cytoscape open source platform for complex network analysis and visualization from the Cytoscape consortium). In the visual depictions of the networks, the thickness of each edge (e.g., each line connecting the proteins) represents the strength of fold change. The edges are also directional indicating causality, and each edge has an associated prediction confidence level.

G. Exemplary Computer System

Figure 17:
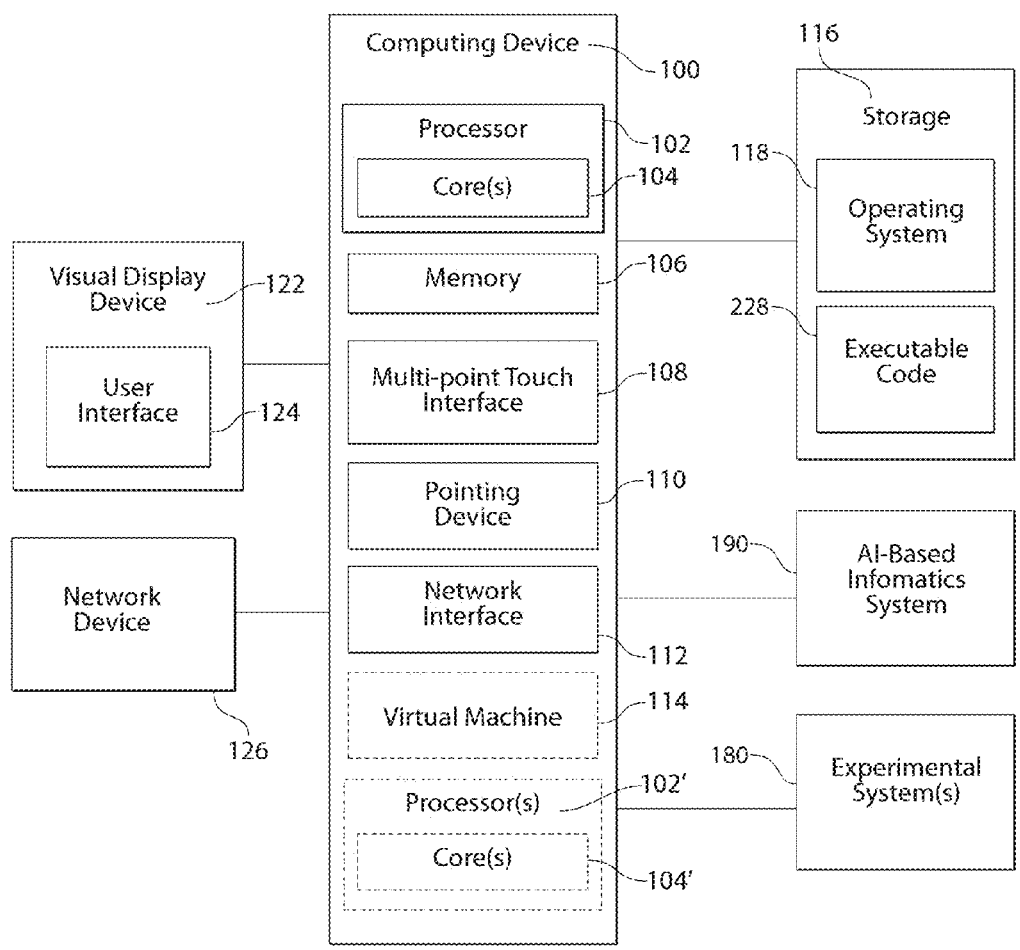
FIG. 17: Schematically depicts an exemplary computing environment suitable for practicing exemplary embodiments taught herein.

FIG. 17 schematically depicts an exemplary computer system/environment that may be employed in some embodiments for communicating with the AI-based informatics system, for generating differential networks, for visualizing networks, for saving and storing data, and/or for interacting with a user. As explained above, calculations for an AI-based informatics system may be performed on a separate supercomputer with hundreds or thousands of parallel processors that interacts, directly or indirectly, with the exemplary computer system. The environment includes a computing device 100 with associated peripheral devices. Computing device 100 is programmable to implement executable code 150 for performing various methods, or portions of methods, taught herein. Computing device 100 includes a storage device 116, such as a hard-drive, CD-ROM, or other non-transitory computer readable media. Storage device 116 may store an operating system 118 and other related software. Computing device 100 may further include memory 106. Memory 106 may comprise a computer system memory or random access memory, such as DRAM, SRAM, EDO RAM, etc. Memory 106 may comprise other types of memory as well, or combinations thereof. Computing device 100 may store, in storage device 116 and/or memory 106, instructions for implementing and processing each portion of the executable code 150.

The executable code 150 may include code for communicating with the AI-based informatics system 190, for generating differential networks (e.g., a differential network creation module), for extracting quantitative relationship information from the AI-based informatics system (e.g., a relationship quantification module) and for visualizing networks (e.g., Cytoscape).

In some embodiments, the computing device 100 may communicate directly or indirectly with the AI-based informatics system 190 (e.g., a system for executing REFS). For example, the computing device 100 may communicate with the AI-based informatics system 190 by transferring data files (e.g., data frames) to the AI-based informatics system 190 through a network. Further, the computing device 100 may have executable code 150 that provides an interface and instructions to the AI-based informatics system 190.

In some embodiments, the computing device 100 may communicate directly or indirectly with one or more experimental systems 180 that provide data for the input data set. Experimental systems 180 for generating data may include systems for mass spectrometry based proteomics, microarray gene expression, qPCR gene expression, mass spectrometry based metabolomics, and mass spectrometry based lipidomics, SNP microarrays, a panel of functional assays, and other in-vitro biology platforms and technologies.

Computing device 100 also includes processor 102, and may include one or more additional processor(s) 102', for executing software stored in the memory 106 and other programs for controlling system hardware, peripheral devices and/or peripheral hardware. Processor 102 and processor(s) 102' each can be a single core processor or multiple core (104 and 104') processor. Virtualization may be employed in computing device 100 so that infrastructure and resources in the computing device can be shared dynamically. Virtualized processors may also be used with executable code 150 and other software in storage device 116. A virtual machine 114 may be provided to handle a process running on multiple processors so that the process appears to be using only one computing resource rather than multiple. Multiple virtual machines can also be used with one processor.

A user may interact with computing device 100 through a visual display device 122, such as a computer monitor, which may display a user interface 124 or any other interface. The user interface 124 of the display device 122 may be used to display raw data, visual representations of networks, etc. The visual display device 122 may also display other aspects or elements of exemplary embodiments (e.g., an icon for storage device 116). Computing device 100 may include other I/O devices such a keyboard or a multi-point touch interface (e.g., a touchscreen) 108 and a pointing device 110, (e.g., a mouse, trackball and/or trackpad) for receiving input from a user. The keyboard 108 and the pointing device 110 may be connected to the visual display device 122 and/or to the computing device 100 via a wired and/or a wireless connection.

Computing device 100 may include a network interface 112 to interface with a network device 126 via a Local Area Network (LAN), Wide Area Network (WAN) or the Internet through a variety of connections including, but not limited to, standard telephone lines, LAN or WAN links (e.g., 802.11, T1, T3, 56 kb, X.25), broadband connections (e.g., ISDN, Frame Relay, ATM), wireless connections, controller area network (CAN), or some combination of any or all of the above. The network interface 112 may comprise a built-in network adapter, network interface card, PCMCIA network card, card bus network adapter, wireless network adapter, USB network adapter, modem or any other device suitable for enabling computing device 100 to interface with any type of network capable of communication and performing the operations described herein.

Moreover, computing device 100 may be any computer system such as a workstation, desktop computer, server, laptop, handheld computer or other form of computing or telecommunications device that is capable of communication and that has sufficient processor power and memory capacity to perform the operations described herein.

Computing device 100 can be running any operating system 118 such as any of the versions of the MICROSOFT WINDOWS operating systems, the different releases of the Unix and Linux operating systems, any version of the MACOS for Macintosh computers, any embedded operating system, any real-time operating system, any open source operating system, any proprietary operating system, any operating systems for mobile computing devices, or any other operating system capable of running on the computing device and performing the operations described herein. The operating system may be running in native mode or emulated mode.

IV. Models for a Biological System and Uses Therefor

A. Establishing a Model for a Biological System

Virtually all biological systems or processes involve complicated interactions among different cell types and/or organ systems. Perturbation of critical functions in one cell type or organ may lead to secondary effects on other interacting cells types and organs, and such downstream changes may in turn feedback to the initial changes and cause further complications. Therefore, it is beneficial to dissect a given biological system or process to its components, such as interaction between pairs of cell types or organs, and systemically probe the interactions between these components in order to gain a more complete, global view of the biological system or process.

Accordingly, the present invention provides cell models for biological systems. To this end, Applicants have built cell models for several exemplary biological systems which have been employed in the subject discovery Platform Technology. Applicants have conducted experiments with the cell models using the subject discovery Platform Technology to generate consensus causal relationship networks, including causal relationships unique in the biological system, and thereby identify "modulators" or critical molecular "drivers" important for the particular biological systems or processes.

One significant advantage of the Platform Technology and its components, e.g., the custom built cell models and data sets obtained from the cell models, is that an initial, "first generation" consensus causal relationship network generated for a biological system or process can continually evolve or expand over time, e.g., by the introduction of additional cell lines/types and/or additional conditions. Additional data from the evolved cell model, i.e., data from the newly added portion(s) of the cell model, can be collected. The new data collected from an expanded or evolved cell model, i.e., from newly added portion(s) of the cell model, can then be introduced to the data sets previously used to generate the "first generation" consensus causal relationship network in order to generate a more robust "second generation" consensus causal relationship network. New causal relationships unique to the biological system can then be identified from the "second generation" consensus causal relationship network. In this way, the evolution of the cell model provides an evolution of the consensus causal relationship networks, thereby providing new and/or more reliable insights into the modulators of the biological system. In this way, both the cell models, the data sets from the cell models, and the causal relationship networks generated from the cell models by using the Platform Technology methods can constantly evolve and build upon previous knowledge obtained from the Platform Technology.

Accordingly, the invention provides consensus causal relationship networks generated from the cell models employed in the Platform Technology. These consensus causal relationship networks may be first generation consensus causal relationship networks, or may be multiple generation consensus causal relationship networks, e.g., $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, $18^{th}$, $19^{th}$, $20^{th}$ or greater generation consensus causal relationship networks. Further, the invention provides simulated consensus causal relationship networks generated from the cell models employed in the Platform Technology. These simulated consensus causal relationship networks may be first generation simulated consensus causal relationship networks, or may be multiple generation simulated consensus causal relationship networks, e.g., $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, $18^{th}$, $19^{th}$, $20^{th}$ or greater simulated generation consensus causal relationship networks. The invention further provides delta networks and delta-delta networks generated from any of the consensus causal relationship networks of the invention.

A custom built cell model for a biological system or process comprises one or more cells associated with the biological system. The model for a biological system/process may be established to simulate an environment of biological system, e.g., environment of a cancer cell in vivo, by creating conditions (e.g., cell culture conditions) that mimic a characteristic aspect of the biological system or process.

Multiple cells of the same or different origin, as opposed to a single cell type, may be included in the cell model. In one embodiment, at least 1, 2, 3, 4, 5, 6, 7, 8, 9, 10, 11, 12, 13, 14, 15, 16, 17, 18, 19, 20, 25, 30, 35, 40, 50 or more different cell lines or cell types are included in the cell model. In one embodiment, the cells are all of the same type, e.g., all breast cancer cells or plant cells, but are different established cell lines, e.g., different established cell lines of breast cancer cells or plant cells. All values presented in the foregoing list can also be the upper or lower limit of ranges, that are intended to be a part of this invention, e.g., between 1 and 5, 1 and 10, 2 and 5, or 5 and 15 different cell lines or cell types.

Examples of cell types that may be included in the cell models of the invention include, without limitation, human cells, animal cells, mammalian cells, plant cells, yeast, bacteria, or fungae. In one embodiment, cells of the cell model can include diseased cells, such as cancer cells or bacterially or virally infected cells. In one embodiment, cells of the cell model can include disease-associated cells, such as cells involved in diabetes, obesity or cardiovascular disease state, e.g., aortic smooth muscle cells or hepatocytes. The skilled person would recognize those cells that are involved in or associated with a particular biological state/process, e.g., disease state/process, and any such cells may be included in a cell model of the invention.

Cell models of the invention may include one or more "control cells." In one embodiment, a control cell may be an untreated or unperturbed cell. In another embodiment, a "control cell" may be a normal, e.g., non-diseased, cell. In one embodiment, at least 1, 2, 3, 4, 5, 6, 7, 8, 9, 10, 11, 12, 13, 14, 15, 16, 17, 18, 19, 20, 25, 30, 35, 40, 45, 50 or more different control cells are included in the cell model. All values presented in the foregoing list can also be the upper or lower limit of ranges, that are intended to be a part of this invention, e.g., between 1 and 5, 1 and 10, 2 and 5, or 5 and 15 different control cell lines or control cell types. In one embodiment, the control cells are all of the same type but are different established cell lines of that cell type. In one embodiment, as a control, one or more normal, e.g., non-diseased, cell lines are cultured under similar conditions, and/or are exposed to the same perturbation, as the primary cells of the cell model in order to identify proteins or pathways unique to the biological state or process.

A custom cell model of the invention may also comprise conditions that mimic a characteristic aspect of the biological state or process. For example, cell culture conditions may be selected that closely approximating the conditions of a cancer cell in a tumor environment in vivo, or of an aortic smooth muscle cell of a patient suffering from cardiovascular disease. In some instances, the conditions are stress conditions. Various conditions/stressors may be employed in the cell models of the invention. In one embodiment, these stressors/conditions may constitute the "perturbation", e.g., external stimulus, for the cell systems. One exemplary stress condition is hypoxia, a condition typically found, for example, within solid tumors. Hypoxia can be induced using art-recognized methods. For example, hypoxia can be induced by placing cell systems in a Modular Incubator Chamber (MIC-101, Billups-Rothenberg Inc. Del Mar, Calif.), which can be flooded with an industrial gas mix containing 5% $CO_2$, 2% $O_2$ and 93% nitrogen. Effects can be measured after a pre-determined period, e.g., at 24 hours after hypoxia treatment, with and without additional external stimulus components (e.g., CoQ10 at 0, 50, or 100 µM). Likewise, lactic acid treatment mimics a cellular environment where glycolysis activity is high. Lactic acid induced stress can be investigated at a final lactic acid concentration of about 12.5 mM at a pre-determined time, e.g., at 24 hours, with or without additional external stimulus components (e.g., CoQ10 at 0, 50, or 100 µM). Hyperglycemia is a condition found in diabetes as well as in cancer. A typical hyperglycemic condition that can be used to treat the subject cells include 10% culture grade glucose added to suitable media to bring up the final concentration of glucose in the media to about 22 mM. Hyperlipidemia is a condition found, for example, in obesity and cardiovascular disease. The hyperlipidemic conditions can be provided by culturing cells in media containing 0.15 mM sodium palmitate. Hyperinsulinemia is a condition found, for example, in diabetes. The hyperinsulinemic conditions may be induced by culturing the cells in media containing 1000 nM insulin.

Individual conditions may be investigated separately in the custom built cell models of the invention, and/or may be combined together. In one embodiment, a combination of at least 2, 3, 4, 5, 6, 7, 8, 9, 10, 15, 20, 25, 30, 40, 50 or more conditions reflecting or simulating different characteristic aspects of the biological system are investigated in the custom built cell model. In one embodiment, individual conditions and, in addition, combinations of at least 2, 3, 4, 5, 6, 7, 8, 9, 10, 11, 12, 13, 14, 15, 20, 25, 30, 35, 40, 45, 50 or more of the conditions reflecting or simulating different characteristic aspects of the biological system are investigated in the custom built cell model. All values presented in the foregoing list can also be the upper or lower limit of ranges, that are intended to be a part of this invention, e.g., between 1 and 5, 1 and 10, 1 and 20, 1 and 30, 2 and 5, 2 and 10, 5 and 10, 1 and 20, 5 and 20, 10 and 20, 10 and 25, 10 and 30 or 10 and 50 different conditions.

Once the custom cell model is built, one or more "perturbations" may be applied to the system, such as genetic variation from patient to patient, or with/without treatment by certain drugs or pro-drugs. See FIG. 15D. The effects of such perturbations to the cell model system can be measured using various art-recognized or proprietary means, as described in section III.B below.

The custom built cell model may be exposed to a perturbation, e.g., an "environmental perturbation" or "external stimulus component". The "environmental perturbation" or "external stimulus component" may be endogenous to the cellular environment (e.g., the cellular environment contains some levels of the stimulant, and more of the same is added to increase its level), or may be exogenous to the cellular environment (e.g., the stimulant/perturbation is largely absent from the cellular environment prior to the alteration). The cellular environment may further be altered by secondary changes resulting from adding the environmental perturbation or external stimulus component, since the external stimulus component may change the cellular output of the cell system, including molecules secreted into the cellular environment by the cell system. The environmental perturbation or external stimulus component may include any external physical and/or chemical stimulus that may affect cellular function. This may include any large or small organic or inorganic molecules, natural or synthetic chemicals, temperature shift, pH change, radiation, light (UVA, UVB etc.), microwave, sonic wave, electrical current, modulated or unmodulated magnetic fields, etc. The environmental perturbation or external stimulus component may also include an introduced genetic modification or mutation or a vehicle (e.g., vector) that causes a genetic modification/mutation.

(i) Cross-Talk Cell Systems

In certain situations, where interaction between two or more cell systems are desired to be investigated, a "cross-talking cell system" may be formed by, for example, bringing the modified cellular environment of a first cell system into contact with a second cell system to affect the cellular output of the second cell system.

As used herein, "cross-talk cell system" comprises two or more cell systems, in which the cellular environment of at least one cell system comes into contact with a second cell system, such that at least one cellular output in the second cell system is changed or affected. In certain embodiments, the cell systems within the cross-talk cell system may be in direct contact with one another. In other embodiments, none of the cell systems are in direct contact with one another.

For example, in certain embodiments, the cross-talk cell system may be in the form of a transwell, in which a first cell system is growing in an insert and a second cell system is growing in a corresponding well compartment. The two cell systems may be in contact with the same or different media, and may exchange some or all of the media components. External stimulus component added to one cell system may be substantially absorbed by one cell system and/or degraded before it has a chance to diffuse to the other cell system. Alternatively, the external stimulus component may eventually approach or reach an equilibrium within the two cell systems.

In certain embodiments, the cross-talk cell system may adopt the form of separately cultured cell systems, where each cell system may have its own medium and/or culture conditions (temperature, $CO_2$ content, pH, etc.), or similar or identical culture conditions. The two cell systems may come into contact by, for example, taking the conditioned medium from one cell system and bringing it into contact with another cell system. Direct cell-cell contacts between the two cell systems can also be effected if desired. For example, the cells of the two cell systems may be co-cultured at any point if desired, and the co-cultured cell systems can later be separated by, for example, FACS sorting when cells in at least one cell system have a sortable marker or label (such as a stably expressed fluorescent marker protein GFP).

Similarly, in certain embodiments, the cross-talk cell system may simply be a co-culture. Selective treatment of cells in one cell system can be effected by first treating the cells in that cell system, before culturing the treated cells in co-culture with cells in another cell system. The co-culture cross-talk cell system setting may be helpful when it is desired to study, for example, effects on a second cell system caused by cell surface changes in a first cell system, after stimulation of the first cell system by an external stimulus component.

The cross-talk cell system of the invention is particularly suitable for exploring the effect of certain pre-determined external stimulus component on the cellular output of one or both cell systems. The primary effect of such a stimulus on the first cell system (with which the stimulus directly contact) may be determined by comparing cellular outputs (e.g., protein expression level) before and after the first cell system's contact with the external stimulus, which, as used herein, may be referred to as "(significant) cellular output differentials." The secondary effect of such a stimulus on the second cell system, which is mediated through the modified cellular environment of the first cell system (such as its secretome), can also be similarly measured. There, a comparison in, for example, proteome of the second cell system can be made between the proteome of the second cell system with the external stimulus treatment on the first cell system, and the proteome of the second cell system without the external stimulus treatment on the first cell system. Any significant changes observed (in proteome or any other cellular outputs of interest) may be referred to as a "significant cellular cross-talk differential."

In making cellular output measurements (such as protein expression), either absolute expression amount or relative expression level may be used. For example, to determine the relative protein expression level of a second cell system, the amount of any given protein in the second cell system, with or without the external stimulus to the first cell system, may be compared to a suitable control cell line and mixture of cell lines and given a fold-increase or fold-decrease value. A pre-determined threshold level for such fold-increase (e.g., at least 1.2, 1.3, 1.4, 1.5, 1.6, 1.7, 1.8, 1.9, 2, 2.5, 3, 3.5, 4, 4.5, 5, 6, 7, 8, 9, 10, 15, 20, 25, 30, 35, 40, 45, 50, 75 or 100 or more fold increase) or fold-decrease (e.g., at least a decrease to 0.95, 0.9, 0.8, 0.75, 0.7, 0.6, 0.5, 0.45, 0.4, 0.35, 0.3, 0.25, 0.2, 0.15, 0.1 or 0.05 fold, or 90%, 80%, 75%, 70%, 65%, 60%, 55%, 50%, 45%, 40%, 35%, 30%, 25%, 20%, 15%, 10% or 5% or less) may be used to select significant cellular cross-talk differentials. All values presented in the foregoing list can also be the upper or lower limit of ranges, e.g., between 1.5 and 5 fold, between 2 and 10 fold, between 1 and 2 fold, or between 0.9 and 0.7 fold, that are intended to be a part of this invention.

Throughout the present application, all values presented in a list, e.g., such as those above, can also be the upper or lower limit of ranges that are intended to be a part of this invention.

To illustrate, in one exemplary two-cell system established to imitate aspects of a cardiovascular disease model, a heart smooth muscle cell line (first cell system) may be treated with a hypoxia condition (an external stimulus component), and proteome changes in a kidney cell line (second cell system) resulting from contacting the kidney cells with conditioned medium of the heart smooth muscle may be measured using conventional quantitative mass spectrometry. Significant cellular cross-talking differentials in these kidney cells may be determined, based on comparison with a proper control (e.g., similarly cultured kidney cells contacted with conditioned medium from similarly cultured heart smooth muscle cells not treated with hypoxia conditions).

Not every observed significant cellular cross-talking differentials may be of biological significance. With respect to any given biological system for which the subject interrogative biological assessment is applied, some (or maybe all) of the significant cellular cross-talking differentials may be "determinative" with respect to the specific biological problem at issue, e.g., either responsible for causing a disease condition (a potential target for therapeutic intervention) or is a biomarker for the disease condition (a potential diagnostic or prognostic factor).

Such determinative cross-talking differentials may be selected by an end user of the subject method, or it may be selected by a bioinformatics software program, such as DAVID-enabled comparative pathway analysis program, or the KEGG pathway analysis program. In certain embodiments, more than one bioinformatics software program is used, and consensus results from two or more bioinformatics software programs are preferred.

As used herein, "differentials" of cellular outputs include differences (e.g., increased or decreased levels) in any one or more parameters of the cellular outputs. For example, in terms of protein expression level, differentials between two cellular outputs, such as the outputs associated with a cell system before and after the treatment by an external stimulus component, can be measured and quantitated by using art-recognized technologies, such as mass-spectrometry based assays (e.g., iTRAQ, 2D-LC-MSMS, etc.).

(ii) Cancer Specific Models

An example of a biological system or process is cancer. As any other complicated biological process or system, cancer is a complicated pathological condition characterized by multiple unique aspects. For example, due to its high growth rate, many cancer cells are adapted to grow in hypoxia conditions, have up-regulated glycolysis and reduced oxidative phosphorylation metabolic pathways. As a result, cancer cells may react differently to an environmental perturbation, such as treatment by a potential drug, as compared to the reaction by a normal cell in response to the same treatment. Thus, it would be of interest to decipher cancer's unique responses to drug treatment as compared to the responses of normal cells. To this end, a custom cancer model may be established to simulate the environment of a cancer cell, e.g., within a tumor in vivo, by choosing appropriate cancer cell lines and creating cell culture conditions that mimic a characteristic aspect of the disease state or process. For example, cell culture conditions may be selected that closely approximating the conditions of a cancer cell in a tumor in vivo, or to mimic various aspects of cancer growth, by isolating different growth conditions of the cancer cells.

Multiple cancer cells of the same or different origin (for example, cancer lines PaCa2, HepG2, PC3 and MCF7), as opposed to a single cancer cell type, may be included in the cancer model. In one embodiment, at least 2, 3, 4, 5, 6, 7, 8, 9, 10, 11, 12, 13, 14, 15, 16, 17, 18, 19, 20, 25, 30, 35, 40, 45, 50 or more different cancer cell lines or cancer cell types are included in the cancer model. All values presented in the foregoing list can also be the upper or lower limit of ranges, that are intended to be a part of this invention, e.g., between 1 and 5, 1 and 10, 2 and 5, or 5 and 15 different cancer cell lines or cell types.

In one embodiment, the cancer cells are all of the same type, e.g., all breast cancer cells, but are different established cell lines, e.g., different established cell lines of breast cancer.

Examples of cancer cell types that may be included in the cancer model include, without limitation, lung cancer, breast cancer, prostate cancer, melanoma, squamous cell carcinoma, colorectal cancer, pancreatic cancer, thyroid cancer, endometrial cancer, bladder cancer, kidney cancer, solid tumor, leukemia, non-Hodgkin lymphoma. In one embodiment, a drug-resistant cancer cell may be included in the cancer model. Specific examples of cell lines that may be included in a cancer model include, without limitation, PaCa2, HepG2, PC3 and MCF7 cells. Numerous cancer cell lines are known in the art, and any such cancer cell line may be included in a cancer model of the invention.

Cell models of the invention may include one or more "control cells." In one embodiment, a control cell may be an untreated or unperturbed cancer cell. In another embodiment, a "control cell" may be a normal, non-cancerous cell. Any one of numerous normal, non-cancerous cell lines may be included in the cell model. In one embodiment, the normal cells are one or more of THLE2 and HDFa cells. In one embodiment, at least 1, 2, 3, 4, 5, 6, 7, 8, 9, 10, 11, 12, 13, 14, 15, 16, 17, 18, 19, 20, 25, 30, 35, 40, 45, 50 or more different normal cell types are included in the cancer model. All values presented in the foregoing list can also be the upper or lower limit of ranges, that are intended to be a part of this invention, e.g., between 1 and 5, 1 and 10, 2 and 5, or 5 and 15 different normal cell lines or cell types. In one embodiment, the normal cells are all of the same type, e.g., all healthy epithelial or breast cells, but are different established cell lines, e.g., different established cell lines of epithelial or breast cells. In one embodiment, as a control, one or more normal non-cancerous cell lines (e.g., THLE2 and HDFa) are cultured under similar conditions, and/or are exposed to the same perturbation, as the cancer cells of the cell model in order to identify cancer unique proteins or pathways.

A custom cancer model may also comprise cell culture conditions that mimic a characteristic aspect of the cancerous state or process. For example, cell culture conditions may be selected that closely approximating the conditions of a cancer cell in a tumor environment in vivo, or to mimic various aspects of cancer growth, by isolating different growth conditions of the cancer cells. In some instances the cell culture conditions are stress conditions.

One such cancer "environment", or stress condition, is hypoxia, a condition typically found within a solid tumor. Hypoxia can be induced in cells in cells using art-recognized methods. For example, hypoxia can be induced by placing cell systems in a Modular Incubator Chamber (MIC-101, Billups-Rothenberg Inc. Del Mar, Calif.), which can be flooded with an industrial gas mix containing 5% $CO_2$, 2% $O_2$ and 93% nitrogen. Effects can be measured after a pre-determined period, e.g., at 24 hours after hypoxia treatment, with and without additional external stimulus components (e.g., CoQ10 at 0, 50, or 100 μM).

Likewise, lactic acid treatment of cells mimics a cellular environment where glycolysis activity is high, as exists in the tumor environment in vivo. Lactic acid induced stress can be investigated at a final lactic acid concentration of about 12.5 mM at a pre-determined time, e.g., at 24 hours, with or without additional external stimulus components (e.g., CoQ10 at 0, 50, or 100 μM).

Hyperglycemia is normally a condition found in diabetes; however, hyperglycemia also to some extent mimics one aspect of cancer growth because many cancer cells rely on glucose as their primary source of energy. Exposing subject cells to a typical hyperglycemic condition may include adding 10% culture grade glucose to suitable media, such that the final concentration of glucose in the media is about 22 mM.

Individual conditions reflecting different aspects of cancer growth may be investigated separately in the custom built cancer model, and/or may be combined together. In one embodiment, combinations of at least 2, 3, 4, 5, 6, 7, 8, 9, 10, 15, 20, 25, 30, 40, 50 or more conditions reflecting or simulating different aspects of cancer growth/conditions are investigated in the custom built cancer model. In one embodiment, individual conditions and, in addition, combinations of at least 2, 3, 4, 5, 6, 7, 8, 9, 10, 15, 20, 25, 30, 40, 50 or more of the conditions reflecting or simulating different aspects of cancer growth/conditions are investigated in the custom built cancer model. All values presented in the foregoing list can also be the upper or lower limit of ranges, that are intended to be a part of this invention, e.g., between 1 and 5, 1 and 10, 1 and 20, 1 and 30, 2 and 5, 2 and 10, 5 and 10, 1 and 20, 5 and 20, 10 and 20, 10 and 25, 10 and 30 or 10 and 50 different conditions.

Once the custom cell model is built, one or more "perturbations" may be applied to the system, such as genetic variation from patient to patient, or with/without treatment by certain drugs or pro-drugs. See FIG. 15D. The effects of such perturbations to the system, including the effect on disease related cancer cells, and disease related normal control cells, can be measured using various art-recognized or proprietary means, as described in section III.B below.

In an exemplary experiment, cancer lines PaCa2, HepG2, PC3 and MCF7, and normal cell lines THLE2 and HDFa, are conditioned in each of hyperglycemia, hypoxia, and lactic acid-rich conditions, as well as in all combinations of two or three of three conditions, and in addition with or without an environmental perturbation, specifically treatment by Coenzyme Q10. Listed herein below are such exemplary combinations of conditions, with or without a perturbation, Coenzyme Q10 treatment, that can be used to treat the cancer cells and/or control (e.g., normal) cells of the cancer cell model. Other combinations can be readily formulated depending on the specific interrogative biological assessment that is being conducted.

1. Media only
2. 50 μM CTL Coenzyme Q10
3. 100 μM CTL Coenzyme Q10
4. 12.5 mM Lactic Acid
5. 12.5 mM Lactic Acid+50 μM CTL Coenzyme Q10
6. 12.5 mM Lactic Acid+100 μM CTL Coenzyme Q10
7. Hypoxia
8. Hypoxia+50 μM CTL Coenzyme Q10

9. Hypoxia+100 µM CTL Coenzyme Q10
10. Hypoxia+12.5 mM Lactic Acid
11. Hypoxia+12.5 mM Lactic Acid+50 µM CTL Coenzyme Q10
12. Hypoxia+12.5 mM Lactic Acid+100 µM CTL Coenzyme Q10
13. Media+22 mM Glucose
14. 50 µM CTL Coenzyme Q10+22 mM Glucose
15. 100 µM CTL Coenzyme Q10+22 mM Glucose
16. 12.5 mM Lactic Acid+22 mM Glucose
17. 12.5 mM Lactic Acid+22 mM Glucose+50 µM CTL Coenzyme Q10
18. 12.5 mM Lactic Acid+22 mM Glucose+100 µM CTL Coenzyme Q10
19. Hypoxia+22 mM Glucose
20. Hypoxia+22 mM Glucose+50 µM CTL Coenzyme Q10
21. Hypoxia+22 mM Glucose+100 µM CTL Coenzyme Q10
22. Hypoxia+12.5 mM Lactic Acid+22 mM Glucose
23. Hypoxia+12.5 mM Lactic Acid+22 mM Glucose+50 µM CTL Coenzyme Q10
24. Hypoxia+12.5 mM Lactic Acid+22 mM Glucose+100 µM CTL Coenzyme Q10

In certain situations, cross talk or ECS experiments between different cancer cells (e.g., HepG2 and PaCa2) may be conducted for several inter-related purposes. In some embodiments that involve cross talk, experiments conducted on the cell models are designed to determine modulation of cellular state or function of one cell system or population (e.g., Hepatocarcinoma cell HepG2) by another cell system or population (e.g., Pancreatic cancer PaCa2) under defined treatment conditions (e.g., hyperglycemia, hypoxia (ischemia)). According to a typical setting, a first cell system/population is contacted by an external stimulus components, such as a candidate molecule (e.g., a small drug molecule, a protein) or a candidate condition (e.g., hypoxia, high glucose environment). In response, the first cell system/population changes its transcriptome, proteome, metabolome, and/or interactome, leading to changes that can be readily detected both inside and outside the cell. For example, changes in transcriptome can be measured by the transcription level of a plurality of target mRNAs; changes in proteome can be measured by the expression level of a plurality of target proteins; and changes in metabolome can be measured by the level of a plurality of target metabolites by assays designed specifically for given metabolites. Alternatively, the above referenced changes in metabolome and/or proteome, at least with respect to certain secreted metabolites or proteins, can also be measured by their effects on the second cell system/population, including the modulation of the transcriptome, proteome, metabolome, and interactome of the second cell system/population. Therefore, the experiments can be used to identify the effects of the molecule(s) of interest secreted by the first cell system/population on a second cell system/population under different treatment conditions. The experiments can also be used to identify any proteins that are modulated as a result of signaling from the first cell system (in response to the external stimulus component treatment) to another cell system, by, for example, differential screening of proteomics. The same experimental setting can also be adapted for a reverse setting, such that reciprocal effects between the two cell systems can also be assessed. In general, for this type of experiment, the choice of cell line pairs is largely based on the factors such as origin, disease state and cellular function.

Although two-cell systems are typically involved in this type of experimental setting, similar experiments can also be designed for more than two cell systems by, for example, immobilizing each distinct cell system on a separate solid support.

The custom built cancer model may be established and used throughout the steps of the Platform Technology of the invention to ultimately identify a causal relationship unique in the biological system, by carrying out the steps described herein. It will be understood by the skilled artisan, however, that a custom built cancer model that is used to generate an initial, "first generation" consensus causal relationship network can continually evolve or expand over time, e.g., by the introduction of additional cancer or normal cell lines and/or additional cancer conditions. Additional data from the evolved cancer model, i.e., data from the newly added portion(s) of the cancer model, can be collected. The new data collected from an expanded or evolved cancer model, i.e., from newly added portion(s) of the cancer model, can then be introduced to the data sets previously used to generate the "first generation" consensus causal relationship network in order to generate a more robust "second generation" consensus causal relationship network. New causal relationships unique to the cancer state (or unique to the response of the cancer state to a perturbation) can then be identified from the "second generation" consensus causal relationship network. In this way, the evolution of the cancer model provides an evolution of the consensus causal relationship networks, thereby providing new and/or more reliable insights into the determinative drivers (or modulators) of the cancer state.

(iii) Diabetes/Obesity/Cardiovascular Disease Cell Models

Other examples of a biological system or process are diabetes, obesity and cardiovascular disease. As with cancer, the related disease states of diabetes, obesity and cardiovascular disease are complicated pathological conditions characterized by multiple unique aspects. It would be of interest to identify the proteins/pathways driving the pathogenesis of diabetes/obesity/cardiovascular disease. It would also be of interest to decipher the unique response of cells associated with diabetes/obesity/cardiovascular disease to drug treatment as compared to the responses of normal cells. To this end, a custom diabetes/obesity/cardiovascular model may be established to simulate an environment experienced by disease-relevant cells, by choosing appropriate cell lines and creating cell culture conditions that mimic a characteristic aspect of the disease state or process. For example, cell culture conditions may be selected that closely approximate hyperglycemia, hyperlipidemia, hyperinsulinemia, hypoxia or lactic-acid rich conditions.

Any cells relevant to diabetes/obesity/cardiovascular disease may be included in the diabetes/obesity/cardiovascular disease model. Examples of cells relevant to diabetes/obesity/cardiovascular disease include, for example, adipocytes, myotubes, hepatocytes, aortic smooth muscle cells (HASMC) and proximal tubular cells (e.g., HK2). Multiple cell types of the same or different origin, as opposed to a single cell type, may be included in the diabetes/obesity/cardiovascular disease model. In one embodiment, at least 2, 3, 4, 5, 6, 7, 8, 9, 10, 11, 12, 13, 14, 15, 16, 17, 18, 19, 20, 25, 30, 35, 40, 45, 50 or more different cell types are included in the diabetes/obesity/cardiovascular disease model. All values presented in the foregoing list can also be the upper or lower limit of ranges, that are intended to be a part of this invention, e.g., between 1 and 5, 1 and 10, 2 and 5, or 5 and 15 different cell types. In one embodiment, the cells are all of the same type, e.g., all adipocytes, but are different established cell lines, e.g., different established adipocyte cell lines. Numerous other cell types that are involved in the diabetes/obesity/cardiovascular disease state are known in the art, and any such cells may be included in a diabetes/obesity/cardiovascular disease model of the invention.

Diabetes/obesity/cardiovascular disease cell models of the invention may include one or more "control cells." In one embodiment, a control cell may be an untreated or unperturbed disease-relevant cell, e.g., a cell that is not exposed to a hyperlipidemic or hyperinsulinemic condition. In another embodiment, a "control cell" may be a non-disease relevant cell, such as an epithelial cell. Any one of numerous non-disease relevant cells may be included in the cell model. In one embodiment, at least 2, 3, 4, 5, 6, 7, 8, 9, 10, 11, 12, 13, 14, 15, 16, 17, 18, 19, 20, 25, 30, 35, 40, 45, 50 or more different non-disease relevant cell types are included in the cell model. All values presented in the foregoing list can also be the upper or lower limit of ranges, that are intended to be a part of this invention, e.g., between 1 and 5, 1 and 10, 2 and 5, or 5 and 15 different non-disease relevant cell lines or cell types. In one embodiment, the non-disease relevant cells are all of the same type, e.g., all healthy epithelial or breast cells, but are different established cell lines, e.g., different established cell lines of epithelial or breast cells. In one embodiment, as a control, one or more non-disease relevant cell lines are cultured under similar conditions, and/or are exposed to the same perturbation, as the disease relevant cells of the cell model in order to identify proteins or pathways unique to diabetes/obesity/cardiovascular disease.

A custom diabetes/obesity/cardiovascular disease model may also comprise cell culture conditions that mimic a characteristic aspect of (represent the pathophysiology of) the diabetes/obesity/cardiovascular disease state or process. For example, cell culture conditions may be selected that closely approximate the conditions of a cell relevant to diabetes/obesity/cardiovascular disease in its environment in vivo, or to mimic various aspects of diabetes/obesity/cardiovascular disease. In some instances the cell culture conditions are stress conditions.

Exemplary conditions that represent the pathophysiology of diabetes/obesity/cardiovascular disease include, for example, any one or more of hypoxia, lactic acid rich conditions, hyperglycemia, hyperlimidemia and hyperinsulinemia. Hypoxia can be induced in cells in cells using art-recognized methods. For example, hypoxia can be induced by placing cell systems in a Modular Incubator Chamber (MIC-101, Billups-Rothenberg Inc. Del Mar, Calif.), which can be flooded with an industrial gas mix containing 5% $CO_2$, 2% $O_2$ and 93% nitrogen. Effects can be measured after a pre-determined period, e.g., at 24 hours after hypoxia treatment, with and without additional external stimulus components (e.g., CoQ10 at 0, 50, or 100 μM).

Likewise, lactic acid treatment of cells mimics a cellular environment where glycolysis activity is high. Lactic acid induced stress can be investigated at a final lactic acid concentration of about 12.5 mM at a pre-determined time, e.g., at 24 hours, with or without additional external stimulus components (e.g., CoQ10 at 0, 50, or 100 μM). Hyperglycemia is a condition found in diabetes. Exposing subject cells to a typical hyperglycemic condition may include adding 10% culture grade glucose to suitable media, such that the final concentration of glucose in the media is about 22 mM. Hyperlipidemia is a condition found in obesity and cardiovascular disease. The hyperlipidemic conditions can be provided by culturing cells in media containing 0.15 mM sodium palmitate. Hyperinsulinemia is a condition found in diabetes. The hyperinsulinemic conditions may be induced by culturing the cells in media containing 1000 nM insulin.

Additional conditions that represent the pathophysiology of diabetes/obesity/cardiovascular disease include, for example, any one or more of inflammation, endoplasmic reticulum stress, mitochondrial stress and peroxisomal stress. Methods for creating an inflammatory-like condition in cells are known in the art. For example, an inflammatory condition may be simulated by culturing cells in the presence of TNFalpha and or IL-6. Methods for creating conditions simulating endoplasmic reticulum stress are also known in the art. For example, a conditions simulating endoplasmic reticulum stress may be created by culturing cells in the presence of thapsigargin and/or tunicamycin. Methods for creating conditions simulating mitochondrial stress are also known in the art. For example, a conditions simulating mitochondrial stress may be created by culturing cells in the presence of rapamycin and/or galactose. Methods for creating conditions simulating peroxisomal stress are also known in the art. For example, a conditions simulating peroxisomal stress may be created by culturing cells in the presence of abscisic acid.

Individual conditions reflecting different aspects of diabetes/obesity/cardiovascular disease may be investigated separately in the custom built diabetes/obesity/cardiovascular disease model, and/or may be combined together. In one embodiment, combinations of at least 2, 3, 4, 5, 6, 7, 8, 9, 10, 15, 20, 25, 30, 40, 50 or more conditions reflecting or simulating different aspects of diabetes/obesity/cardiovascular disease are investigated in the custom built diabetes/obesity/cardiovascular disease model. In one embodiment, individual conditions and, in addition, combinations of at least 2, 3, 4, 5, 6, 7, 8, 9, 10, 15, 20, 25, 30, 40, 50 or more of the conditions reflecting or simulating different aspects of diabetes/obesity/cardiovascular disease are investigated in the custom built diabetes/obesity/cardiovascular disease model. All values presented in the foregoing list can also be the upper or lower limit of ranges, that are intended to be a part of this invention, e.g., between 1 and 5, 1 and 10, 1 and 20, 1 and 30, 2 and 5, 2 and 10, 5 and 10, 1 and 20, 5 and 20, 10 and 20, 10 and 25, 10 and 30 or 10 and 50 different conditions.

Once the custom cell model is built, one or more "perturbations" may be applied to the system, such as genetic variation from patient to patient, or with/without treatment by certain drugs or pro-drugs. See FIG. 15D. The effects of such perturbations to the system, including the effect on diabetes/obesity/cardiovascular disease related cells, can be measured using various art-recognized or proprietary means, as described in section III.B below.

In an exemplary experiment, each of adipocytes, myotubes, hepatocytes, aortic smooth muscle cells (HASMC) and proximal tubular cells (HK2), are conditioned in each of hyperglycemia, hypoxia, hyperlipidemia, hyperinsulinemia, and lactic acid-rich conditions, as well as in all combinations of two, three, four and all five conditions, and in addition with or without an environmental perturbation, specifically treatment by Coenzyme Q10. In addition to exemplary combinations of conditions described above in the context of the cancer model, listed herein below are some additional exemplary combinations of conditions, with or without a perturbation, e.g., Coenzyme Q10 treatment, which can be used to treat the diabetes/obesity/cardiovascular disease relevant cells (and/or control cells) of the diabetes/obesity/cardiovascular disease cell model. These are merely intended to be exemplary, and the skilled artisan will appreciate that any individual and/or combination of the above-mentioned conditions that represent the pathophysiology of diabetes/obesity/cardiovascular disease may be employed in the cell model to produce output data sets. Other combinations can be readily formulated depending on the specific interrogative biological assessment that is being conducted.

1. Media only
2. 50 μM CTL Coenzyme Q10
3. 100 μM CTL Coenzyme Q10
4. 0.15 mM sodium palmitate
5. 0.15 mM sodium palmitate+50 μM CTL Coenzyme Q10
6. 0.15 mM sodium palmitate+100 μM CTL Coenzyme Q10
7. 1000 nM insulin
8. 1000 nM insulin+50 μM CTL Coenzyme Q10
9. 1000 nM insulin+100 μM CTL Coenzyme Q10
10. 1000 nM insulin+0.15 mM sodium palmitate
11. 1000 nM insulin+0.15 mM sodium palmitate+50 μM CTL Coenzyme Q10
12. 1000 nM insulin+0.15 mM sodium palmitate+100 μM CTL Coenzyme Q10

In certain situations, cross talk or ECS experiments between different disease-relevant cells (e.g., HASMC and HK2 cells, or liver cells and adipocytes) may be conducted for several inter-related purposes. In some embodiments that involve cross talk, experiments conducted on the cell models are designed to determine modulation of cellular state or function of one cell system or population (e.g., liver cells) by another cell system or population (e.g., adipocytes) under defined treatment conditions (e.g., hyperglycemia, hypoxia, hyperlipidemia, hyperinsulinemia). According to a typical setting, a first cell system/population is contacted by an external stimulus components, such as a candidate molecule (e.g., a small drug molecule, a protein) or a candidate condition (e.g., hypoxia, high glucose environment). In response, the first cell system/population changes its transcriptome, proteome, metabolome, and/or interactome, leading to changes that can be readily detected both inside and outside the cell. For example, changes in transcriptome can be measured by the transcription level of a plurality of target mRNAs; changes in proteome can be measured by the expression level of a plurality of target proteins; and changes in metabolome can be measured by the level of a plurality of target metabolites by assays designed specifically for given metabolites. Alternatively, the above referenced changes in metabolome and/or proteome, at least with respect to certain secreted metabolites or proteins, can also be measured by their effects on the second cell system/population, including the modulation of the transcriptome, proteome, metabolome, and interactome of the second cell system/population. Therefore, the experiments can be used to identify the effects of the molecule(s) of interest secreted by the first cell system/population on a second cell system/population under different treatment conditions. The experiments can also be used to identify any proteins that are modulated as a result of signaling from the first cell system (in response to the external stimulus component treatment) to another cell system, by, for example, differential screening of proteomics. The same experimental setting can also be adapted for a reverse setting, such that reciprocal effects between the two cell systems can also be assessed. In general, for this type of experiment, the choice of cell line pairs is largely based on the factors such as origin, disease state and cellular function.

Although two-cell systems are typically involved in this type of experimental setting, similar experiments can also be designed for more than two cell systems by, for example, immobilizing each distinct cell system on a separate solid support.

The custom built diabetes/obesity/cardiovascular disease model may be established and used throughout the steps of the Platform Technology of the invention to ultimately identify a causal relationship unique to the diabetes/obesity/cardiovascular disease state, by carrying out the steps described herein. It will be understood by the skilled artisan, however, that just as with a cancer model, a custom built diabetes/obesity/cardiovascular disease model that is used to generate an initial, "first generation" consensus causal relationship network can continually evolve or expand over time, e.g., by the introduction of additional disease-relevant cell lines and/or additional disease-relevant conditions. Additional data from the evolved diabetes/obesity/cardiovascular disease model, i.e., data from the newly added portion(s) of the cancer model, can be collected. The new data collected from an expanded or evolved model, i.e., from newly added portion(s) of the model, can then be introduced to the data sets previously used to generate the "first generation" consensus causal relationship network in order to generate a more robust "second generation" consensus causal relationship network. New causal relationships unique to the diabetes/obesity/cardiovascular disease state (or unique to the response of the diabetes/obesity/cardiovascular disease state to a perturbation) can then be identified from the "second generation" consensus causal relationship network. In this way, the evolution of the diabetes/obesity/cardiovascular disease model provides an evolution of the consensus causal relationship networks, thereby providing new and/or more reliable insights into the determinative drivers (or modulators) of the diabetes/obesity/cardiovascular disease state.

B. Use of Cell Models for Interrogative Biological Assessments

The methods and cell models provided in the present invention may be used for, or applied to, any number of "interrogative biological assessments." Use of the methods of the invention for an interrogative biological assessment facilitates the identification of "modulators" or determinative cellular process "drivers" of a biological system.

As used herein, an "interrogative biological assessment" may include the identification of one or more modulators of a biological system, e.g., determinative cellular process "drivers," (e.g., an increase or decrease in activity of a biological pathway, or key members of the pathway, or key regulators to members of the pathway) associated with the environmental perturbation or external stimulus component, or a unique causal relationship unique in a biological system or process. It may further include additional steps designed to test or verify whether the identified determinative cellular process drivers are necessary and/or sufficient for the downstream events associated with the environmental perturbation or external stimulus component, including in vivo animal models and/or in vitro tissue culture experiments.

In certain embodiments, the interrogative biological assessment is the diagnosis or staging of a disease state, wherein the identified modulators of a biological system, e.g., determinative cellular process drivers (e.g., cross-talk differentials or causal relationships unique in a biological system or process) represent either disease markers or therapeutic targets that can be subject to therapeutic intervention. The subject interrogative biological assessment is suitable for any disease condition in theory, but may found particularly useful in areas such as oncology/cancer biology, diabetes, obesity, cardiovascular disease, and neurological conditions (especially neuro-degenerative diseases, such as, without limitation, Alzheimer's disease, Parkinson's disease, Huntington's disease, Amyotrophic lateral sclerosis (ALS), and aging related neurodegeneration).

In certain embodiments, the interrogative biological assessment is the determination of the efficacy of a drug, wherein the identified modulators of a biological system, e.g., determinative cellular process driver (e.g., cross-talk differentials or causal relationships unique in a biological system or process) may be the hallmarks of a successful drug, and may in turn be used to identify additional agents, such as MIMs or epishifters, for treating the same disease condition.

In certain embodiments, the interrogative biological assessment is the identification of drug targets for preventing or treating infection (e.g., bacterial or viral infection), wherein the identified determinative cellular process driver (e.g., cellular cross-talk differentials or causal relationships unique in a biological system or process) may be markers/indicators or key biological molecules causative of the infective state, and may in turn be used to identify anti-infective agents.

In certain embodiments, the interrogative biological assessment is the assessment of a molecular effect of an agent, e.g., a drug, on a given disease profile, wherein the identified modulators of a biological system, e.g., determinative cellular process driver (e.g., cellular cross-talk differentials or causal relationships unique in a biological system or process) may be an increase or decrease in activity of one or more biological pathways, or key members of the pathway(s), or key regulators to members of the pathway(s), and may in turn be used, e.g., to predict the therapeutic efficacy of the agent for the given disease.

In certain embodiments, the interrogative biological assessment is the assessment of the toxicological profile of an agent, e.g., a drug, on a cell, tissue, organ or organism, wherein the identified modulators of a biological system, e.g., determinative cellular process driver (e.g., cellular cross-talk differentials or causal relationships unique in a biological system or process) may be indicators of toxicity, e.g., cytotoxicity, and may in turn be used to predict or identify the toxicological profile of the agent. In one embodiment, the identified modulators of a biological system, e.g., determinative cellular process driver (e.g., cellular cross-talk differentials or causal relationships unique in a biological system or process) is an indicator of cardiotoxicity of a drug or drug candidate, and may in turn be used to predict or identify the cardiotoxicological profile of the drug or drug candidate.

In certain embodiments, the interrogative biological assessment is the identification of drug targets for preventing or treating a disease or disorder caused by biological weapons, such as disease-causing protozoa, fungi, bacteria, protests, viruses, or toxins, wherein the identified modulators of a biological system, e.g., determinative cellular process driver (e.g., cellular cross-talk differentials or causal relationships unique in a biological system or process) may be markers/indicators or key biological molecules causative of said disease or disorder, and may in turn be used to identify biodefense agents.

In certain embodiments, the interrogative biological assessment is the identification of targets for anti-aging agents, such as anti-aging cosmetics, wherein the identified modulators of a biological system, e.g., determinative cellular process driver (e.g., cellular cross-talk differentials or causal relationships unique in a biological system or process) may be markers or indicators of the aging process, particularly the aging process in skin, and may in turn be used to identify anti-aging agents.

In one exemplary cell model for aging that is used in the methods of the invention to identify targets for anti-aging cosmetics, the cell model comprises an aging epithelial cell that is, for example, treated with UV light (an environmental perturbation or external stimulus component), and/or neonatal cells, which are also optionally treated with UV light. In one embodiment, a cell model for aging comprises a cellular cross-talk system. In one exemplary two-cell cross-talk system established to identify targets for anti-aging cosmetics, an aging epithelial cell (first cell system) may be treated with UV light (an external stimulus component), and changes, e.g., proteomic changes and/or functional changes, in a neonatal cell (second cell system) resulting from contacting the neonatal cells with conditioned medium of the treated aging epithelial cell may be measured, e.g., proteome changes may be measured using conventional quantitative mass spectrometry, or a causal relationship unique in aging may be identified from a causal relationship network generated from the data.

V. Proteomic Sample Analysis

In certain embodiments, the subject method employs large-scale high-throughput quantitative proteomic analysis of hundreds of samples of similar character, and provides the data necessary for identifying the cellular output differentials.

There are numerous art-recognized technologies suitable for this purpose. An exemplary technique, iTRAQ analysis in combination with mass spectrometry, is briefly described below.

To provide reference samples for relative quantification with the iTRAQ technique, multiple QC pools are created. Two separate QC pools, consisting of aliquots of each sample, were generated from the Cell #1 and Cell #2 samples—these samples are denoted as QCS1 and QCS2, and QCP1 and QCP2 for supernatants and pellets, respectively. In order to allow for protein concentration comparison across the two cell lines, cell pellet aliquots from the QC pools described above are combined in equal volumes to generate reference samples (QCP).

The quantitative proteomics approach is based on stable isotope labeling with the 8-plex iTRAQ reagent and 2D-LC MALDI MS/MS for peptide identification and quantification. Quantification with this technique is relative: peptides and proteins are assigned abundance ratios relative to a reference sample. Common reference samples in multiple iTRAQ experiments facilitate the comparison of samples across multiple iTRAQ experiments.

To implement this analysis scheme, six primary samples and two control pool samples are combined into one 8-plex iTRAQ mix, with the control pool samples labeled with 113 and 117 reagents according to the manufacturer's suggestions. This mixture of eight samples is then fractionated by two-dimensional liquid chromatography; strong cation exchange (SCX) in the first dimension, and reversed-phase HPLC in the second dimension. The HPLC eluent is directly fractionated onto MALDI plates, and the plates are analyzed on an MDS SCIEX/AB 4800 MALDI TOF/TOF mass spectrometer.

In the absence of additional information, it is assumed that the most important changes in protein expression are those within the same cell types under different treatment conditions. For this reason, primary samples from Cell#1 and Cell#2 are analyzed in separate iTRAQ mixes. To facilitate comparison of protein expression in Cell#1 vs. Cell#2 samples, universal QCP samples are analyzed in the available "iTRAQ slots" not occupied by primary or cell line specific QC samples (QC1 and QC2).

A brief overview of the laboratory procedures employed is provided herein.

A. Protein Extraction from Cell Supernatant Samples

For cell supernatant samples (CSN), proteins from the culture medium are present in a large excess over proteins secreted by the cultured cells. In an attempt to reduce this background, upfront abundant protein depletion was implemented. As specific affinity columns are not available for bovine or horse serum proteins, an anti-human IgY14 column was used. While the antibodies are directed against human proteins, the broad specificity provided by the polyclonal nature of the antibodies was anticipated to accomplish depletion of both bovine and equine proteins present in the cell culture media that was used.

A 200-µl aliquot of the CSN QC material is loaded on a 10-mL IgY14 depletion column before the start of the study to determine the total protein concentration (Bicinchoninic acid (BCA) assay) in the flow-through material. The loading volume is then selected to achieve a depleted fraction containing approximately 40 µg total protein.

B. Protein Extraction from Cell Pellets

An aliquot of Cell #1 and Cell #2 is lysed in the "standard" lysis buffer used for the analysis of tissue samples at BGM, and total protein content is determined by the BCA assay. Having established the protein content of these representative cell lystates, all cell pellet samples (including QC samples described in Section 1.1) were processed to cell lysates. Lysate amounts of approximately 40 µg of total protein were carried forward in the processing workflow.

C. Sample Preparation for Mass Spectrometry

Sample preparation follows standard operating procedures and constitute of the following:
Reduction and alkylation of proteins
Protein clean-up on reversed-phase column (cell pellets only)
Digestion with trypsin
iTRAQ labeling
Strong cation exchange chromatography—collection of six fractions (Agilent 1200 system)
HPLC fractionation and spotting to MALDI plates (Dionex Ultimate3000/Probot system)

D. MALDI MS and MS/MS

HPLC-MS generally employs online ESI MS/MS strategies. BG Medicine uses an off-line LC-MALDI MS/MS platform that results in better concordance of observed protein sets across the primary samples without the need of injecting the same sample multiple times. Following first pass data collection across all iTRAQ mixes, since the peptide fractions are retained on the MALDI target plates, the samples can be analyzed a second time using a targeted MS/MS acquisition pattern derived from knowledge gained during the first acquisition. In this manner, maximum observation frequency for all of the identified proteins is accomplished (ideally, every protein should be measured in every iTRAQ mix).

E. Data Processing

The data processing process within the BGM Proteomics workflow can be separated into those procedures such as preliminary peptide identification and quantification that are completed for each iTRAQ mix individually (Section 1.5.1) and those processes (Section 1.5.2) such as final assignment of peptides to proteins and final quantification of proteins, which are not completed until data acquisition is completed for the project.

The main data processing steps within the BGM Proteomics workflow are:
Peptide identification using the Mascot (Matrix Sciences) database search engine
Automated in house validation of Mascot IDs
Quantification of peptides and preliminary quantification of proteins
Expert curation of final dataset
Final assignment of peptides from each mix into a common set of proteins using the automated PVT tool
Outlier elimination and final quantification of proteins (i) Data Processing of Individual iTRAQ Mixes As each iTRAQ mix is processed through the workflow the MS/MS spectra are analyzed using proprietary BGM software tools for peptide and protein identifications, as well as initial assessment of quantification information. Based on the results of this preliminary analysis, the quality of the workflow for each primary sample in the mix is judged against a set of BGM performance metrics. If a given sample (or mix) does not pass the specified minimal performance metrics, and additional material is available, that sample is repeated in its entirety and it is data from this second implementation of the workflow that is incorporated in the final dataset.

(ii) Peptide Identification

MS/MS spectra was searched against the Uniprot protein sequence database containing human, bovine, and horse sequences augmented by common contaminant sequences such as porcine trypsin. The details of the Mascot search parameters, including the complete list of modifications, are given in Table 3.

TABLE 3

| Mascot Search Parameters | |
| --- | --- |
| Precursor mass tolerance | 100 ppm |
| Fragment mass tolerance | 0.4 Da |
| Variable modifications | N-term iTRAQ8 |
| | Lysine iTRAQ8 |
| | Cys carbamidomethyl |
| | Pyro-Glu (N-term) |
| | Pyro-Carbamidomethyl Cys (N-term) |
| | Deamidation (N only) |
| | Oxidation (M) |
| Enzyme specificity | Fully Tryptic |
| Number of missed tryptic sites allowed | 2 |
| Peptide rank considered | 1 |

After the Mascot search is complete, an auto-validation procedure is used to promote (i.e., validate) specific Mascot peptide matches. Differentiation between valid and invalid matches is based on the attained Mascot score relative to the expected Mascot score and the difference between the Rank 1 peptides and Rank 2 peptide Mascot scores. The criteria required for validation are somewhat relaxed if the peptide is one of several matched to a single protein in the iTRAQ mix or if the peptide is present in a catalogue of previously validated peptides.

(iii) Peptide and Protein Quantification

The set of validated peptides for each mix is utilized to calculate preliminary protein quantification metrics for each mix. Peptide ratios are calculated by dividing the peak area from the iTRAQ label (i.e., m/z 114, 115, 116, 118, 119, or 121) for each validated peptide by the best representation of the peak area of the reference pool (QC1 or QC2). This peak area is the average of the 113 and 117 peaks provided both samples pass QC acceptance criteria. Preliminary protein ratios are determined by calculating the median ratio of all "useful" validated peptides matching to that protein. "Useful" peptides are fully iTRAQ labeled (all N-terminal are labeled with either Lysine or PyroGlu) and fully Cysteine labeled (i.e., all Cys residues are alkylated with Carbamidomethyl or N-terminal Pyro-cmc).

(iv) Post-Acquisition Processing

Once all passes of MS/MS data acquisition are complete for every mix in the project, the data is collated using the three steps discussed below which are aimed at enabling the results from each primary sample to be simply and meaningfully compared to that of another.

(v) Global Assignment of Peptide Sequences to Proteins

Final assignment of peptide sequences to protein accession numbers is carried out through the proprietary Protein Validation Tool (PVT). The PVT procedure determines the best, minimum non-redundant protein set to describe the entire collection of peptides identified in the project. This is an automated procedure that has been optimized to handle data from a homogeneous taxonomy.

Protein assignments for the supernatant experiments were manually curated in order to deal with the complexities of mixed taxonomies in the database. Since the automated paradigm is not valid for cell cultures grown in bovine and horse serum supplemented media, extensive manual curation is necessary to minimize the ambiguity of the source of any given protein.

(vi) Normalization of Peptide Ratios

The peptide ratios for each sample are normalized based on the method of Vandesompele et al. *Genome Biology*, 2002, 3(7), research 0034.1-11. This procedure is applied to the cell pellet measurements only. For the supernatant samples, quantitative data are not normalized considering the largest contribution to peptide identifications coming from the media.

(vii) Final Calculation of Protein Ratios

A standard statistical outlier elimination procedure is used to remove outliers from around each protein median ratio, beyond the 1.96 τ level in the log-transformed data set. Following this elimination process, the final set of protein ratios are (re-)calculated.

VI. Markers of the Invention and Uses Thereof

The present invention is based, at least in part, on the identification of novel biomarkers that are associated with a biological system, such as a disease process, or response of a biological system to a perturbation, such as a therapeutic agent.

In particular, the invention relates to markers (hereinafter "markers" or "markers of the invention"), which are described in the examples. The invention provides nucleic acids and proteins that are encoded by or correspond to the markers (hereinafter "marker nucleic acids" and "marker proteins," respectively). These markers are particularly useful in diagnosing disease states; prognosing disease states; developing drug targets for varies disease states; screening for the presence of toxicity, preferably drug-induced toxicity, e.g., cardiotoxicity; identifying an agent that cause or is at risk for causing toxicity; identifying an agent that can reduce or prevent drug-induced toxicity; alleviating, reducing or preventing drug-induced cardiotoxicity; and identifying markers predictive of drug-induced cardiotoxicity.

A "marker" is a gene whose altered level of expression in a tissue or cell from its expression level in normal or healthy tissue or cell is associated with a disease state such as cancer, diabetes, obesity, cardiovascular disease, or a toxicity state, such as a drug-induced toxicity, e.g., cardiotoxicity. A "marker nucleic acid" is a nucleic acid (e.g., mRNA, cDNA) encoded by or corresponding to a marker of the invention. Such marker nucleic acids include DNA (e.g., cDNA) comprising the entire or a partial sequence of any of the genes that are markers of the invention or the complement of such a sequence. Such sequences are known to the one of skill in the art and can be found for example, on the NIH government pubmed website. The marker nucleic acids also include RNA comprising the entire or a partial sequence of any of the gene markers of the invention or the complement of such a sequence, wherein all thymidine residues are replaced with uridine residues. A "marker protein" is a protein encoded by or corresponding to a marker of the invention. A marker protein comprises the entire or a partial sequence of any of the marker proteins of the invention. Such sequences are known to the one of skill in the art and can be found for example, on the NIH government pubmed website. The terms "protein" and "polypeptide" are used interchangeably.

A "disease state or toxic state associated" body fluid is a fluid which, when in the body of a patient, contacts or passes through sarcoma cells or into which cells or proteins shed from sarcoma cells are capable of passing. Exemplary disease state or toxic state associated body fluids include blood fluids (e.g. whole blood, blood serum, blood having platelets removed therefrom), and are described in more detail below. Disease state or toxic state associated body fluids are not limited to, whole blood, blood having platelets removed therefrom, lymph, prostatic fluid, urine and semen.

The "normal" level of expression of a marker is the level of expression of the marker in cells of a human subject or patient not afflicted with a disease state or a toxicity state.

An "over-expression" or "higher level of expression" of a marker refers to an expression level in a test sample that is greater than the standard error of the assay employed to assess expression, and is preferably at least twice, and more preferably three, four, five, six, seven, eight, nine or ten times the expression level of the marker in a control sample (e.g., sample from a healthy subject not having the marker associated a disease state or a toxicity state, e.g., cancer, diabetes, obesity, cardiovascular disease, and cardiotoxicity) and preferably, the average expression level of the marker in several control samples.

A "lower level of expression" of a marker refers to an expression level in a test sample that is at least twice, and more preferably three, four, five, six, seven, eight, nine or ten times lower than the expression level of the marker in a control sample (e.g., sample from a healthy subjects not having the marker associated a disease state or a toxicity state, e.g., cancer, diabetes, obesity, cardiovascular disease, and cardiotoxicity) and preferably, the average expression level of the marker in several control samples.

A "transcribed polynucleotide" or "nucleotide transcript" is a polynucleotide (e.g. an mRNA, hnRNA, a cDNA, or an analog of such RNA or cDNA) which is complementary to or homologous with all or a portion of a mature mRNA made by transcription of a marker of the invention and normal post-transcriptional processing (e.g. splicing), if any, of the RNA transcript, and reverse transcription of the RNA transcript.

"Complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

"Homologous" as used herein, refers to nucleotide sequence similarity between two regions of the same nucleic acid strand or between regions of two different nucleic acid strands. When a nucleotide residue position in both regions is occupied by the same nucleotide residue, then the regions are homologous at that position. A first region is homologous to a second region if at least one nucleotide residue position of each region is occupied by the same residue. Homology between two regions is expressed in terms of the proportion of nucleotide residue positions of the two regions that are occupied by the same nucleotide residue. By way of example, a region having the nucleotide sequence 5'-ATT-GCC-3' and a region having the nucleotide sequence 5'-TATGGC-3' share 50% homology. Preferably, the first region comprises a first portion and the second region comprises a second portion, whereby, at least about 50%, and preferably at least about 75%, at least about 90%, or at least about 95% of the nucleotide residue positions of each of the portions are occupied by the same nucleotide residue. More preferably, all nucleotide residue positions of each of the portions are occupied by the same nucleotide residue.

"Proteins of the invention" encompass marker proteins and their fragments; variant marker proteins and their fragments; peptides and polypeptides comprising an at least 15 amino acid segment of a marker or variant marker protein; and fusion proteins comprising a marker or variant marker protein, or an at least 15 amino acid segment of a marker or variant marker protein.

The invention further provides antibodies, antibody derivatives and antibody fragments which specifically bind with the marker proteins and fragments of the marker proteins of the present invention. Unless otherwise specified herewithin, the terms "antibody" and "antibodies" broadly encompass naturally-occurring forms of antibodies (e.g., IgG, IgA, IgM, IgE) and recombinant antibodies such as single-chain antibodies, chimeric and humanized antibodies and multi-specific antibodies, as well as fragments and derivatives of all of the foregoing, which fragments and derivatives have at least an antigenic binding site. Antibody derivatives may comprise a protein or chemical moiety conjugated to an antibody.

In certain embodiments, the markers of the invention include one or more genes (or proteins) selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, CANX, GRP78, GRP75, TIMP1, PTX3, HSP76, PDIA4, PDIA1, CA2D1, GPAT1 and TAZ. In some embodiments, the markers are a combination of at least two, three, four, five, six, seven, eight, nine, ten, eleven, twelve, thirteen, fourteen, fifteen, sixteen, seventeen, eighteen, nineteen, twenty, twenty-five, thirty, or more of the foregoing genes (or proteins). All values presented in the foregoing list can also be the upper or lower limit of ranges, that are intended to be a part of this invention, e.g., between 1 and 5, 1 and 10, 1 and 20, 1 and 30, 2 and 5, 2 and 10, 5 and 10, 1 and 20, 5 and 20, 10 and 20, 10 and 25, 10 and 30 of the foregoing genes (or proteins).

In one embodiment, the markers of the invention are genes or proteins associated with or involved in cancer. Such genes or proteins involved in cancer include, for example, HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and/or CANX. In some embodiments, the markers of the invention are a combination of at least two, three, four, five, six, seven, eight, nine, ten, eleven, twelve, thirteen, fourteen, fifteen, sixteen, seventeen, eighteen, nineteen, twenty or more of the foregoing genes (or proteins). All values presented in the foregoing list can also be the upper or lower limit of ranges, that are intended to be a part of this invention, e.g., between 1 and 5, 1 and 10, 1 and 20, 1 and 30, 2 and 5, 2 and 10, 5 and 10, 1 and 20, 5 and 20, 10 and 20, 10 and 25, 10 and 30 of the foregoing genes (or proteins).

In one embodiment, the markers of the invention are genes or proteins associated with or involved in drug-induced toxicity. Such genes or proteins involved in drug-induced toxicity include, for example, GRP78, GRP75, TIMP1, PTX3, HSP76, PDIA4, PDIA1, CA2D1, GPAT1 and/or TAZ. In some embodiments, the markers of the invention are a combination of at least two, three, four, five, six, seven, eight, nine, ten of the foregoing genes (or proteins). All values presented in the foregoing list can also be the upper or lower limit of ranges, that are intended to be a part of this invention, e.g., between 1 and 5, 1 and 10, 1 and 20, 1 and 30, 2 and 5, 2 and 10, 5 and 10, 1 and 20, 5 and 20, 10 and 20, 10 and 25, and 30 of the foregoing genes (or proteins).

A. Cardiotoxicity Associated Markers

The present invention is based, at least in part, on the identification of novel biomarkers that are associated with drug-induced cardiotoxicity. The invention is further based, at least in part, on the discovery that Coenzyme Q10 is capable of reducing or preventing drug-induced cardiotoxicity.

Accordingly, the invention provides methods for identifying an agent that causes or is at risk for causing toxicity. In one embodiment, the agent is a drug or drug candidate. In one embodiment, the toxicity is drug-induced toxicity, e.g., cardiotoxicity. In one embodiment, the agent is a drug or drug candidate for treating diabetes, obesity or a cardiovascular disorder. In these methods, the amount of one or more biomarkers/proteins in a pair of samples (a first sample not subject to the drug treatment, and a second sample subjected to the drug treatment) is assessed. A modulation in the level of expression of the one or more biomarkers in the second sample as compared to the first sample is an indication that the drug causes or is at risk for causing drug-induced toxicity, e.g., cardiotoxicity. In one embodiment, the one or more biomarkers is selected from the group consisting of GRP78, GRP75, TIMP1, PTX3, HSP76, PDIA4, PDIA1, CA2D1, GPAT1 and TAZ. The methods of the present invention can be practiced in conjunction with any other method used by the skilled practitioner to identify a drug at risk for causing drug-induced cardiotoxocity.

Accordingly, in one aspect, the invention provides a method for identifying a drug that causes or is at risk for causing drug-induced toxicity (e.g., cardiotoxicity), comprising: comparing (i) the level of expression of one or more biomarkers present in a first cell sample obtained prior to the treatment with the drug; with (ii) the level of expression of the one or more biomarkers present in a second cell sample obtained following the treatment with the drug; wherein the one or more biomarkers is selected from the group consisting of GRP78, GRP75, TIMP1, PTX3, HSP76, PDIA4, PDIA1, CA2D1, GPAT1 and TAZ; wherein a modulation in the level of expression of the one or more biomarkers in the second sample as compared to the first sample is an indication that the drug causes or is at risk for causing drug-induced toxicity (e.g., cardiotoxicity).

In one embodiment, the drug-induced toxicity is drug-induced cardiotoxicity. In one embodiment, the cells are cells of the cardiovascular system, e.g., cardiomyocytes. In one embodiment, the cells are diabetic cardiomyocytes. In one embodiment, the drug is a drug or candidate drug for treating diabetes, obesity or cardiovascular disease.

In one embodiment, a modulation (e.g., an increase or a decrease) in the level of expression of one, two, three, four, five, six, seven, eight, nine or all ten of the biomarkers selected from the group consisting of GRP78, GRP75, TIMP1, PTX3, HSP76, PDIA4, PDIA1, CA2D1, GPAT1 and TAZ in the second sample as compared to the first sample is an indication that the drug causes or is at risk for causing drug-induced toxicity.

Methods for identifying an agent that can reduce or prevent drug-induced toxicity are also provided by the invention. In one embodiment, the drug-induced toxicity is cardiotoxicity. In one embodiment, the drug is a drug or drug candidate for treating diabetes, obesity or a cardiovascular disorder. In these methods, the amount of one or more biomarkers in three samples (a first sample not subjected to the drug treatment, a second sample subjected to the drug treatment, and a third sample subjected both to the drug treatment and the agent) is assessed. Approximately the same level of expression of the one or more biomarkers in the third sample as compared to the first sample is an indication that the agent can reduce or prevent drug-induced toxicity, e.g., drug-induced cardiotoxicity. In one embodiment, the one or more biomarkers is selected from the group consisting of GRP78, GRP75, TIMP1, PTX3, HSP76, PDIA4, PDIA1, CA2D1, GPAT1 and TAZ.

Using the methods described herein, a variety of molecules, particularly including molecules sufficiently small to be able to cross the cell membrane, may be screened in order to identify molecules which modulate, e.g., increase or decrease the expression and/or activity of a marker of the invention. Compounds so identified can be provided to a subject in order to reduce, alleviate or prevent drug-induced toxicity in the subject.

Accordingly, in another aspect, the invention provides a method for identifying an agent that can reduce or prevent drug-induced toxicity comprising: (i) determining the level of expression of one or more biomarkers present in a first cell sample obtained prior to the treatment with a toxicity inducing drug; (ii) determining the level of expression of the one or more biomarkers present in a second cell sample obtained following the treatment with the toxicity inducing drug; (iii) determining the level of expression of the one or more biomarkers present in a third cell sample obtained following the treatment with the toxicity inducing drug and the agent; and (iv) comparing the level of expression of the one or more biomarkers present in the third sample with the first sample; wherein the one or more biomarkers is selected from the group consisting of GRP78, GRP75, TIMP1, PTX3, HSP76, PDIA4, PDIA1, CA2D1, GPAT1 and TAZ; and wherein about the same level of expression of the one or more biomarkers in the third sample as compared to the first sample is an indication that the agent can reduce or prevent drug-induced toxicity.

In one embodiment, the drug-induced toxicity is drug-induced cardiotoxicity. In one embodiment, the cells are cells of the cardiovascular system, e.g., cardiomyocytes. In one embodiment, the cells are diabetic cardiomyocytes. In one embodiment, the drug is a drug or candidate drug for treating diabetes, obesity or cardiovascular disease.

In one embodiment, about the same level of expression of one, two, three, four, five, six, seven, eight, nine or all ten of the biomarkers selected from the group consisting of GRP78, GRP75, TIMP1, PTX3, HSP76, PDIA4, PDIA1, CA2D1, GPAT1 and TAZ in the third sample as compared to the first sample is an indication that the agent can reduce or prevent drug-induced toxicity.

The invention further provides methods for alleviating, reducing or preventing drug-induced cardiotoxicity in a subject in need thereof, comprising administering to a subject (e.g., a mammal, a human, or a non-human animal) an agent identified by the screening methods provided herein, thereby reducing or preventing drug-induced cardiotoxicity in the subject. In one embodiment, the agent is administered to a subject that has already been treated with a cardiotoxicity-inducing drug. In one embodiment, the agent is administered to a subject at the same time as treatment of the subject with a cardiotoxicity-inducing drug. In one embodiment, the agent is administered to a subject prior to treatment of the subject with a cardiotoxicity-inducing drug.

The invention further provides methods for alleviating, reducing or preventing drug-induced cardiotoxicity in a subject in need thereof, comprising administering Coenzyme Q10 to the subject (e.g., a mammal, a human, or a non-human animal), thereby reducing or preventing drug-induced cardiotoxicity in the subject. In one embodiment, the Coenzyme Q10 is administered to a subject that has already been treated with a cardiotoxicity-inducing drug. In one embodiment, the Coenzyme Q10 is administered to a subject at the same time as treatment of the subject with a cardiotoxicity-inducing drug. In one embodiment, the Coenzyme Q10 is administered to a subject prior to treatment of the subject with a cardiotoxicity-inducing drug. In one embodiment, the drug-induced cardiotoxicity is associated with modulation of expression of one, two, three, four, five, six, seven, eight, nine or all ten of the biomarkers selected from the group consisting of GRP78, GRP75, TIMP1, PTX3, HSP76, PDIA4, PDIA1, CA2D1, GPAT1 and TAZ. All values presented in the foregoing list can also be the upper or lower limit of ranges, that are intended to be a part of this invention, e.g., between 1 and 5, 1 and 10, 2 and 5, 2 and 10, or 5 and 10 of the foregoing genes (or proteins).

The invention further provides biomarkers (e.g, genes and/or proteins) that are useful as predictive markers for cardiotoxicity, e.g., drug-induced cardiotoxicity. These biomarkers include GRP78, GRP75, TIMP1, PTX3, HSP76, PDIA4, PDIA1, CA2D1, GPAT1 and TAZ. The ordinary skilled artisan would, however, be able to identify additional biomarkers predictive of drug-induced cardiotoxicity by employing the methods described herein, e.g., by carrying out the methods described in Example 3 but by using a different drug known to induce cardiotoxicity. Exemplary drug-induced cardiotoxicity biomarkers of the invention are further described below.

GRP78 and GRP75 are also referred to as glucose response proteins. These proteins are associated with endo/sarcoplasmic reticulum stress (ER stress) of cardiomyocytes. SERCA, or sarcoendoplasmic reticulum calcium ATPase, regulates Ca2+ homeostatsis in cardiac cells. Any disruption of these ATPase can lead to cardiac dysfunction and heart failure. Based upon the data provided herein, GRP75 and GRP78 and the edges around them are novel predictors of drug induced cardiotoxicity.

TIMP1, also referred to as TIMP metalloprotease inhibitor 1, is involved with remodeling of extra cellular matrix in association with MMPs. TIMP1 expression is correlated with fibrosis of the heart, and hypoxia of vascular endothelial cells also induces TIMP1 expression. Based upon the data provided herein, TIMP1 is a novel predictor of drug induced cardiactoxicity PTX3, also referred to as Pentraxin 3, belongs to the family of C Reactive Proteins (CRP) and is a good marker of an inflammatory condition of the heart. However, plasma PTX3 could also be representative of systemic inflammatory response due to sepsis or other medical conditions. Based upon the data provided herein, PTX3 may be a novel marker of cardiac function or cardiotoxicity. Additionally, the edges associated with PTX 3 in the network could form a novel panel of biomarkers.

HSP76, also referred to as HSPA6, is only known to be expressed in endothelial cells and B lymphocytes. There is no known role for this protein in cardiac function. Based upon the data provided herein, HSP76 may be a novel predictor of drug induced cardiotoxicity PDIA4, PDIA1, also referred to as protein disulphide isomerase family A proteins, are associated with ER stress response, like GRPs. There is no known role for these proteins in cardiac function. Based upon the data provided herein, these proteins may be novel predictors of drug induced cardiotoxicity.

CA2D1 is also referred to as calcium channel, voltage-dependent, alpha 2/delta subunit. The alpha-2/delta subunit of voltage-dependent calcium channel regulates calcium current density and activation/inactivation kinetics of the calcium channel. CA2D1 plays an important role in excitation-contraction coupling in the heart. There is no known role for this protein in cardiac function. Based upon the data provided herein, CA2D1 is a novel predictor of drug induced cardiotoxicity GPAT1 is one of four known glycerol-3-phosphate acyltransferase isoforms, and is located on the mitochondrial outer membrane, allowing reciprocal regulation with carnitine palmitoyltransferase-1. GPAT1 is upregulated transcriptionally by insulin and SREBP-1c and downregulated acutely by AMP-activated protein kinase, consistent with a role in triacylglycerol synthesis. Based upon the data provided herein, GPAT1 is a novel predictor of drug induced cardiotoxicity.

TAZ, also referred to as Tafazzin, is highly expressed in cardiac and skeletal muscle. TAZ is involved in the metabolism of cardiolipin and functions as a phospholipid-lysophospholipid transacylase. Tafazzin is responsible for remodeling of a phospholipid cardiolipin (CL), the signature lipid of the mitochondrial inner membrane. Based upon the data provided herein, TAZ is a novel predictor of drug induced cardiotoxicity B. Cancer Associated Markers The present invention is based, at least in part, on the identification of novel biomarkers that are associated with cancer. Such markers associated in cancer include, for example, HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and/or CANX. In some embodiments, the markers of the invention are a combination of at least two, three, four, five, six, seven, eight, nine, ten, eleven, twelve, thirteen, fourteen, fifteen, sixteen, seventeen, eighteen, nineteen, twenty or more of the foregoing markers.

Accordingly, the invention provides methods for identifying an agent that causes or is at risk for causing cancer. In one embodiment, the agent is a drug or drug candidate. In these methods, the amount of one or more biomarkers/proteins in a pair of samples (a first sample not subject to the drug treatment, and a second sample subjected to the drug treatment) is assessed. A modulation in the level of expression of the one or more biomarkers in the second sample as compared to the first sample is an indication that the drug causes or is at risk for causing cancer. In one embodiment, the one or more biomarkers is selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX. The methods of the present invention can be practiced in conjunction with any other method used by the skilled practitioner to identify a drug at risk for causing the cancer.

In one aspect, the invention provides methods for assessing the efficacy of a therapy for treating a cancer in a subject, the method comprising: comparing the level of expression of one or more markers present in a first sample obtained from the subject prior to administering at least a portion of the treatment regimen to the subject, wherein the one or more markers is selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX; and the level of expression of the one or more markers present in a second sample obtained from the subject following administration of at least a portion of the treatment regimen, wherein a modulation in the level of expression of the one or more markers in the second sample as compared to the first sample is an indication that the therapy is efficacious for treating the cancer in the subject.

In one embodiment, the sample comprises a fluid obtained from the subject. In one embodiment, the fluid is selected from the group consisting of blood fluids, vomit, saliva, lymph, cystic fluid, urine, fluids collected by bronchial lavage, fluids collected by peritoneal rinsing, and gynecological fluids. In one embodiment, the sample is a blood sample or a component thereof.

In another embodiment, the sample comprises a tissue or component thereof obtained from the subject. In one embodiment, the tissue is selected from the group consisting of bone, connective tissue, cartilage, lung, liver, kidney, muscle tissue, heart, pancreas, and skin.

In one embodiment, the subject is a human.

In one embodiment, the level of expression of the one or more markers in the biological sample is determined by assaying a transcribed polynucleotide or a portion thereof in the sample. In one embodiment, wherein assaying the transcribed polynucleotide comprises amplifying the transcribed polynucleotide.

In one embodiment, the level of expression of the marker in the subject sample is determined by assaying a protein or a portion thereof in the sample. In one embodiment, the protein is assayed using a reagent which specifically binds with the protein.

In one embodiment, the level of expression of the one or more markers in the sample is determined using a technique selected from the group consisting of polymerase chain reaction (PCR) amplification reaction, reverse-transcriptase PCR analysis, single-strand conformation polymorphism analysis (SSCP), mismatch cleavage detection, heteroduplex analysis, Southern blot analysis, Northern blot analysis, Western blot analysis, in situ hybridization, array analysis, deoxyribonucleic acid sequencing, restriction fragment length polymorphism analysis, and combinations or sub-combinations thereof, of said sample.

In one embodiment, the level of expression of the marker in the sample is determined using a technique selected from the group consisting of immunohistochemistry, immunocytochemistry, flow cytometry, ELISA and mass spectrometry.

In one embodiment, the level of expression of a plurality of markers is determined.

In one embodiment, the subject is being treated with a therapy selected from the group consisting of an environmental influencer compound, surgery, radiation, hormone therapy, antibody therapy, therapy with growth factors, cytokines, chemotherapy, allogenic stem cell therapy. In one embodiment, the environmental influencer compound is a Coenzyme Q10 molecule.

The invention further provides methods of assessing whether a subject is afflicted with a cancer, the method comprising: determining the level of expression of one or more markers present in a biological sample obtained from the subject, wherein the one or more markers is selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX; and comparing the level of expression of the one or more markers present in the biological sample obtained from the subject with the level of expression of the one or more markers present in a control sample, wherein a modulation in the level of expression of the one or more markers in the biological sample obtained from the subject relative to the level of expression of the one or more markers in the control sample is an indication that the subject is afflicted with cancer, thereby assessing whether the subject is afflicted with the cancer.

In one embodiment, the sample comprises a fluid obtained from the subject. In one embodiment, the fluid is selected from the group consisting of blood fluids, vomit, saliva, lymph, cystic fluid, urine, fluids collected by bronchial lavage, fluids collected by peritoneal rinsing, and gynecological fluids. In one embodiment, the sample is a blood sample or a component thereof.

In another embodiment, the sample comprises a tissue or component thereof obtained from the subject. In one embodiment, the tissue is selected from the group consisting of bone, connective tissue, cartilage, lung, liver, kidney, muscle tissue, heart, pancreas, and skin.

In one embodiment, the subject is a human.

In one embodiment, the level of expression of the one or more markers in the biological sample is determined by assaying a transcribed polynucleotide or a portion thereof in the sample. In one embodiment, wherein assaying the transcribed polynucleotide comprises amplifying the transcribed polynucleotide.

In one embodiment, the level of expression of the marker in the subject sample is determined by assaying a protein or a portion thereof in the sample. In one embodiment, the protein is assayed using a reagent which specifically binds with the protein.

In one embodiment, the level of expression of the one or more markers in the sample is determined using a technique selected from the group consisting of polymerase chain reaction (PCR) amplification reaction, reverse-transcriptase PCR analysis, single-strand conformation polymorphism analysis (SSCP), mismatch cleavage detection, heteroduplex analysis, Southern blot analysis, Northern blot analysis, Western blot analysis, in situ hybridization, array analysis, deoxyribonucleic acid sequencing, restriction fragment length polymorphism analysis, and combinations or sub-combinations thereof, of said sample.

In one embodiment, the level of expression of the marker in the sample is determined using a technique selected from the group consisting of immunohistochemistry, immunocytochemistry, flow cytometry, ELISA and mass spectrometry.

In one embodiment, the level of expression of a plurality of markers is determined.

In one embodiment, the subject is being treated with a therapy selected from the group consisting of an environmental influencer compound, surgery, radiation, hormone therapy, antibody therapy, therapy with growth factors, cytokines, chemotherapy, allogenic stem cell therapy. In one embodiment, the environmental influencer compound is a Coenzyme Q10 molecule.

The invention further provides methods of prognosing whether a subject is predisposed to developing a cancer, the method comprising: determining the level of expression of one or more markers present in a biological sample obtained from the subject, wherein the one or more markers is selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX; and comparing the level of expression of the one or more markers present in the biological sample obtained from the subject with the level of expression of the one or more markers present in a control sample, wherein a modulation in the level of expression of the one or more markers in the biological sample obtained from the subject relative to the level of expression of the one or more markers in the control sample is an indication that the subject is predisposed to developing cancer, thereby prognosing whether the subject is predisposed to developing the cancer.

In one embodiment, the sample comprises a fluid obtained from the subject. In one embodiment, the fluid is selected from the group consisting of blood fluids, vomit, saliva, lymph, cystic fluid, urine, fluids collected by bronchial lavage, fluids collected by peritoneal rinsing, and gynecological fluids. In one embodiment, the sample is a blood sample or a component thereof.

In another embodiment, the sample comprises a tissue or component thereof obtained from the subject. In one embodiment, the tissue is selected from the group consisting of bone, connective tissue, cartilage, lung, liver, kidney, muscle tissue, heart, pancreas, and skin.

In one embodiment, the subject is a human.

In one embodiment, the level of expression of the one or more markers in the biological sample is determined by assaying a transcribed polynucleotide or a portion thereof in the sample. In one embodiment, wherein assaying the transcribed polynucleotide comprises amplifying the transcribed polynucleotide.

In one embodiment, the level of expression of the marker in the subject sample is determined by assaying a protein or a portion thereof in the sample. In one embodiment, the protein is assayed using a reagent which specifically binds with the protein.

In one embodiment, the level of expression of the one or more markers in the sample is determined using a technique selected from the group consisting of polymerase chain reaction (PCR) amplification reaction, reverse-transcriptase PCR analysis, single-strand conformation polymorphism analysis (SSCP), mismatch cleavage detection, heteroduplex analysis, Southern blot analysis, Northern blot analysis, Western blot analysis, in situ hybridization, array analysis, deoxyribonucleic acid sequencing, restriction fragment length polymorphism analysis, and combinations or sub-combinations thereof, of said sample.

In one embodiment, the level of expression of the marker in the sample is determined using a technique selected from the group consisting of immunohistochemistry, immunocytochemistry, flow cytometry, ELISA and mass spectrometry.

In one embodiment, the level of expression of a plurality of markers is determined.

In one embodiment, the subject is being treated with a therapy selected from the group consisting of an environmental influencer compound, surgery, radiation, hormone therapy, antibody therapy, therapy with growth factors, cytokines, chemotherapy, allogenic stem cell therapy. In one embodiment, the environmental influencer compound is a Coenzyme Q10 molecule.

The invention further provides methods of prognosing the recurrence of a cancer in a subject, the method comprising: determining the level of expression of one or more markers present in a biological sample obtained from the subject, wherein the one or more markers is selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX; and comparing the level of expression of the one or more markers present in the biological sample obtained from the subject with the level of expression of the one or more markers present in a control sample, wherein a modulation in the level of expression of the one or more markers in the biological sample obtained from the subject relative to the level of expression of the one or more markers in the control sample is an indication of the recurrence of cancer, thereby prognosing the recurrence of the cancer in the subject.

In one embodiment, the sample comprises a fluid obtained from the subject. In one embodiment, the fluid is selected from the group consisting of blood fluids, vomit, saliva, lymph, cystic fluid, urine, fluids collected by bronchial lavage, fluids collected by peritoneal rinsing, and gynecological fluids. In one embodiment, the sample is a blood sample or a component thereof.

In another embodiment, the sample comprises a tissue or component thereof obtained from the subject. In one embodiment, the tissue is selected from the group consisting of bone, connective tissue, cartilage, lung, liver, kidney, muscle tissue, heart, pancreas, and skin.

In one embodiment, the subject is a human.

In one embodiment, the level of expression of the one or more markers in the biological sample is determined by assaying a transcribed polynucleotide or a portion thereof in the sample. In one embodiment, wherein assaying the transcribed polynucleotide comprises amplifying the transcribed polynucleotide.

In one embodiment, the level of expression of the marker in the subject sample is determined by assaying a protein or a portion thereof in the sample. In one embodiment, the protein is assayed using a reagent which specifically binds with the protein.

In one embodiment, the level of expression of the one or more markers in the sample is determined using a technique selected from the group consisting of polymerase chain reaction (PCR) amplification reaction, reverse-transcriptase PCR analysis, single-strand conformation polymorphism analysis (SSCP), mismatch cleavage detection, heteroduplex analysis, Southern blot analysis, Northern blot analysis, Western blot analysis, in situ hybridization, array analysis, deoxyribonucleic acid sequencing, restriction fragment length polymorphism analysis, and combinations or sub-combinations thereof, of said sample.

In one embodiment, the level of expression of the marker in the sample is determined using a technique selected from the group consisting of immunohistochemistry, immunocytochemistry, flow cytometry, ELISA and mass spectrometry.

In one embodiment, the level of expression of a plurality of markers is determined.

In one embodiment, the subject is being treated with a therapy selected from the group consisting of an environmental influencer compound, surgery, radiation, hormone therapy, antibody therapy, therapy with growth factors, cytokines, chemotherapy, allogenic stem cell therapy. In one embodiment, the environmental influencer compound is a Coenzyme Q10 molecule.

The invention further provides methods of prognosing the survival of a subject with a cancer, the method comprising: determining the level of expression of one or more markers present in a biological sample obtained from the subject, wherein the one or more markers is selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX; and comparing the level of expression of the one or more markers present in the biological sample obtained from the subject with the level of expression of the one or more markers present in a control sample, wherein a modulation in the level of expression of the one or more markers in the biological sample obtained from the subject relative to the level of expression of the one or more markers in the control sample is an indication of survival of the subject, thereby prognosing survival of the subject with the cancer.

In one embodiment, the sample comprises a fluid obtained from the subject. In one embodiment, the fluid is selected from the group consisting of blood fluids, vomit, saliva, lymph, cystic fluid, urine, fluids collected by bronchial lavage, fluids collected by peritoneal rinsing, and gynecological fluids. In one embodiment, the sample is a blood sample or a component thereof.

In another embodiment, the sample comprises a tissue or component thereof obtained from the subject. In one embodiment, the tissue is selected from the group consisting of bone, connective tissue, cartilage, lung, liver, kidney, muscle tissue, heart, pancreas, and skin.

In one embodiment, the subject is a human.

In one embodiment, the level of expression of the one or more markers in the biological sample is determined by assaying a transcribed polynucleotide or a portion thereof in the sample. In one embodiment, wherein assaying the transcribed polynucleotide comprises amplifying the transcribed polynucleotide.

In one embodiment, the level of expression of the marker in the subject sample is determined by assaying a protein or a portion thereof in the sample. In one embodiment, the protein is assayed using a reagent which specifically binds with the protein.

In one embodiment, the level of expression of the one or more markers in the sample is determined using a technique selected from the group consisting of polymerase chain reaction (PCR) amplification reaction, reverse-transcriptase PCR analysis, single-strand conformation polymorphism analysis (SSCP), mismatch cleavage detection, heteroduplex analysis, Southern blot analysis, Northern blot analysis, Western blot analysis, in situ hybridization, array analysis, deoxyribonucleic acid sequencing, restriction fragment length polymorphism analysis, and combinations or subcombinations thereof, of said sample.

In one embodiment, the level of expression of the marker in the sample is determined using a technique selected from the group consisting of immunohistochemistry, immunocytochemistry, flow cytometry, ELISA and mass spectrometry.

In one embodiment, the level of expression of a plurality of markers is determined.

In one embodiment, the subject is being treated with a therapy selected from the group consisting of an environmental influencer compound, surgery, radiation, hormone therapy, antibody therapy, therapy with growth factors, cytokines, chemotherapy, allogenic stem cell therapy. In one embodiment, the environmental influencer compound is a Coenzyme Q10 molecule.

The invention further provides methods of monitoring the progression of a cancer in a subject, the method comprising: comparing, the level of expression of one or more markers present in a first sample obtained from the subject prior to administering at least a portion of a treatment regimen to the subject and the level of expression of the one or more markers present in a second sample obtained from the subject following administration of at least a portion of the treatment regimen, wherein the one or more markers is selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX, thereby monitoring the progression of the cancer in the subject.

In one embodiment, the sample comprises a fluid obtained from the subject. In one embodiment, the fluid is selected from the group consisting of blood fluids, vomit, saliva, lymph, cystic fluid, urine, fluids collected by bronchial lavage, fluids collected by peritoneal rinsing, and gynecological fluids. In one embodiment, the sample is a blood sample or a component thereof.

In another embodiment, the sample comprises a tissue or component thereof obtained from the subject. In one embodiment, the tissue is selected from the group consisting of bone, connective tissue, cartilage, lung, liver, kidney, muscle tissue, heart, pancreas, and skin.

In one embodiment, the subject is a human.

In one embodiment, the level of expression of the one or more markers in the biological sample is determined by assaying a transcribed polynucleotide or a portion thereof in the sample. In one embodiment, wherein assaying the transcribed polynucleotide comprises amplifying the transcribed polynucleotide.

In one embodiment, the level of expression of the marker in the subject sample is determined by assaying a protein or a portion thereof in the sample. In one embodiment, the protein is assayed using a reagent which specifically binds with the protein.

In one embodiment, the level of expression of the one or more markers in the sample is determined using a technique selected from the group consisting of polymerase chain reaction (PCR) amplification reaction, reverse-transcriptase PCR analysis, single-strand conformation polymorphism analysis (SSCP), mismatch cleavage detection, heteroduplex analysis, Southern blot analysis, Northern blot analysis, Western blot analysis, in situ hybridization, array analysis, deoxyribonucleic acid sequencing, restriction fragment length polymorphism analysis, and combinations or subcombinations thereof, of said sample.

In one embodiment, the level of expression of the marker in the sample is determined using a technique selected from the group consisting of immunohistochemistry, immunocytochemistry, flow cytometry, ELISA and mass spectrometry.

In one embodiment, the level of expression of a plurality of markers is determined.

In one embodiment, the subject is being treated with a therapy selected from the group consisting of an environmental influencer compound, surgery, radiation, hormone therapy, antibody therapy, therapy with growth factors, cytokines, chemotherapy, allogenic stem cell therapy. In one embodiment, the environmental influencer compound is a Coenzyme Q10 molecule.

The invention further provides methods of identifying a compound for treating a cancer in a subject, the method comprising: obtaining a biological sample from the subject; contacting the biological sample with a test compound; determining the level of expression of one or more markers present in the biological sample obtained from the subject, wherein the one or more markers is selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX with a positive fold change and/or with a negative fold change; comparing the level of expression of the one of more markers in the biological sample with an appropriate control; and selecting a test compound that decreases the level of expression of the one or more markers with a negative fold change present in the biological sample and/or increases the level of expression of the one or more markers with a positive fold change present in the biological sample, thereby identifying a compound for treating the cancer in a subject.

In one embodiment, the sample comprises a fluid obtained from the subject. In one embodiment, the fluid is selected from the group consisting of blood fluids, vomit, saliva, lymph, cystic fluid, urine, fluids collected by bronchial lavage, fluids collected by peritoneal rinsing, and gynecological fluids. In one embodiment, the sample is a blood sample or a component thereof.

In another embodiment, the sample comprises a tissue or component thereof obtained from the subject. In one embodiment, the tissue is selected from the group consisting of bone, connective tissue, cartilage, lung, liver, kidney, muscle tissue, heart, pancreas, and skin.

In one embodiment, the subject is a human.

In one embodiment, the level of expression of the one or more markers in the biological sample is determined by assaying a transcribed polynucleotide or a portion thereof in the sample. In one embodiment, wherein assaying the transcribed polynucleotide comprises amplifying the transcribed polynucleotide.

In one embodiment, the level of expression of the marker in the subject sample is determined by assaying a protein or a portion thereof in the sample. In one embodiment, the protein is assayed using a reagent which specifically binds with the protein.

In one embodiment, the level of expression of the one or more markers in the sample is determined using a technique selected from the group consisting of polymerase chain reaction (PCR) amplification reaction, reverse-transcriptase PCR analysis, single-strand conformation polymorphism analysis (SSCP), mismatch cleavage detection, heteroduplex analysis, Southern blot analysis, Northern blot analysis, Western blot analysis, in situ hybridization, array analysis, deoxyribonucleic acid sequencing, restriction fragment length polymorphism analysis, and combinations or sub-combinations thereof, of said sample.

In one embodiment, the level of expression of the marker in the sample is determined using a technique selected from the group consisting of immunohistochemistry, immunocytochemistry, flow cytometry, ELISA and mass spectrometry.

In one embodiment, the level of expression of a plurality of markers is determined.

In one embodiment, the subject is being treated with a therapy selected from the group consisting of an environmental influencer compound, surgery, radiation, hormone therapy, antibody therapy, therapy with growth factors, cytokines, chemotherapy, allogenic stem cell therapy. In one embodiment, the environmental influencer compound is a Coenzyme Q10 molecule.

The invention further provides a kit for assessing the efficacy of a therapy for treating a cancer, the kit comprising reagents for determining the level of expression of at least one marker selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX and instructions for use of the kit to assess the efficacy of the therapy for treating the cancer.

The invention further provides a kit for assessing whether a subject is afflicted with a cancer, the kit comprising reagents for determining the level of expression of at least one marker selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX and instructions for use of the kit to assess whether the subject is afflicted with the cancer.

The invention further provides a kit for prognosing whether a subject is predisposed to developing a cancer, the kit comprising reagents for determining the level of expression of at least one marker selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX and instructions for use of the kit to prognose whether the subject is predisposed to developing the cancer.

The invention further provides a kit for prognosing the recurrence of a cancer in a subject, the kit comprising reagents for assessing the level of expression of at least one marker selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX and instructions for use of the kit to prognose the recurrence of the cancer.

The invention further provides a kit for prognosing the recurrence of a cancer, the kit comprising reagents for determining the level of expression of at least one marker selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX and instructions for use of the kit to prognose the recurrence of the cancer.

The invention further provides a kit for prognosing the survival of a subject with a cancer, the kit comprising reagents for determining the level of expression of at least one marker selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX and instructions for use of the kit to prognose the survival of the subject with the cancer.

The invention further provides a kit for monitoring the progression of a cancer in a subject, the kit comprising reagents for determining the level of expression of at least one marker selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, and CANX and instructions for use of the kit to prognose the progression of the cancer in a subject.

The kits of the invention may further comprising means for obtaining a biological sample from a subject, a control sample, and/or an environmental influencer compound The means for determining the level of expression of at least one marker may comprises means for assaying a transcribed polynucleotide or a portion thereof in the sample and/or means for assaying a protein or a portion thereof in the sample.

In one embodiment, the kits comprises reagents for determining the level of expression of a plurality of markers. Various aspects of the invention are described in further detail in the following subsections.

C. Isolated Nucleic Acid Molecules

One aspect of the invention pertains to isolated nucleic acid molecules, including nucleic acids which encode a marker protein or a portion thereof. Isolated nucleic acids of the invention also include nucleic acid molecules sufficient for use as hybridization probes to identify marker nucleic acid molecules, and fragments of marker nucleic acid molecules, e.g., those suitable for use as PCR primers for the amplification or mutation of marker nucleic acid molecules. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule is one which is separated from other nucleic acid molecules which are present in the natural source of the nucleic acid molecule. In one embodiment, an "isolated" nucleic acid molecule is free of sequences (preferably protein-encoding sequences) which naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kB, 4 kB, 3 kB, 2 kB, 1 kB, 0.5 kB or 0.1 kB of nucleotide sequences which naturally flank the nucleic acid molecule in genomic DNA of the cell from which the nucleic acid is derived. In another embodiment, an "isolated" nucleic acid molecule, such as a cDNA molecule, can be substantially free of other cellular material, or culture medium when produced by recombinant techniques, or substantially free of chemical precursors or other chemicals when chemically synthesized. A nucleic acid molecule that is substantially free of cellular material includes preparations having less than about 30%, 20%, 10%, or 5% of heterologous nucleic acid (also referred to herein as a "contaminating nucleic acid").

A nucleic acid molecule of the present invention can be isolated using standard molecular biology techniques and the sequence information in the database records described herein. Using all or a portion of such nucleic acid sequences, nucleic acid molecules of the invention can be isolated using standard hybridization and cloning techniques (e.g., as described in Sambrook et al., ed., *Molecular Cloning: A Laboratory Manual, 2nd ed.*, Cold Spring Harbor Laboratory Press, Cold Spring Harbor, N.Y., 1989).

A nucleic acid molecule of the invention can be amplified using cDNA, mRNA, or genomic DNA as a template and appropriate oligonucleotide primers according to standard PCR amplification techniques. The nucleic acid so amplified can be cloned into an appropriate vector and characterized by DNA sequence analysis. Furthermore, nucleotides corresponding to all or a portion of a nucleic acid molecule of the invention can be prepared by standard synthetic techniques, e.g., using an automated DNA synthesizer.

In another preferred embodiment, an isolated nucleic acid molecule of the invention comprises a nucleic acid molecule which has a nucleotide sequence complementary to the nucleotide sequence of a marker nucleic acid or to the nucleotide sequence of a nucleic acid encoding a marker protein. A nucleic acid molecule which is complementary to a given nucleotide sequence is one which is sufficiently complementary to the given nucleotide sequence that it can hybridize to the given nucleotide sequence thereby forming a stable duplex.

Moreover, a nucleic acid molecule of the invention can comprise only a portion of a nucleic acid sequence, wherein the full length nucleic acid sequence comprises a marker nucleic acid or which encodes a marker protein. Such nucleic acids can be used, for example, as a probe or primer. The probe/primer typically is used as one or more substantially purified oligonucleotides. The oligonucleotide typically comprises a region of nucleotide sequence that hybridizes under stringent conditions to at least about 7, preferably about 15, more preferably about 25, 50, 75, 100, 125, 150, 175, 200, 250, 300, 350, or 400 or more consecutive nucleotides of a nucleic acid of the invention.

Probes based on the sequence of a nucleic acid molecule of the invention can be used to detect transcripts or genomic sequences corresponding to one or more markers of the invention. The probe comprises a label group attached thereto, e.g., a radioisotope, a fluorescent compound, an enzyme, or an enzyme co-factor. Such probes can be used as part of a diagnostic test kit for identifying cells or tissues which mis-express the protein, such as by measuring levels of a nucleic acid molecule encoding the protein in a sample of cells from a subject, e.g., detecting mRNA levels or determining whether a gene encoding the protein has been mutated or deleted.

The invention further encompasses nucleic acid molecules that differ, due to degeneracy of the genetic code, from the nucleotide sequence of nucleic acids encoding a marker protein, and thus encode the same protein.

It will be appreciated by those skilled in the art that DNA sequence polymorphisms that lead to changes in the amino acid sequence can exist within a population (e.g., the human population). Such genetic polymorphisms can exist among individuals within a population due to natural allelic variation. An allele is one of a group of genes which occur alternatively at a given genetic locus. In addition, it will be appreciated that DNA polymorphisms that affect RNA expression levels can also exist that may affect the overall expression level of that gene (e.g., by affecting regulation or degradation).

As used herein, the phrase "allelic variant" refers to a nucleotide sequence which occurs at a given locus or to a polypeptide encoded by the nucleotide sequence.

As used herein, the terms "gene" and "recombinant gene" refer to nucleic acid molecules comprising an open reading frame encoding a polypeptide corresponding to a marker of the invention. Such natural allelic variations can typically result in 1-5% variance in the nucleotide sequence of a given gene. Alternative alleles can be identified by sequencing the gene of interest in a number of different individuals. This can be readily carried out by using hybridization probes to identify the same genetic locus in a variety of individuals. Any and all such nucleotide variations and resulting amino acid polymorphisms or variations that are the result of natural allelic variation and that do not alter the functional activity are intended to be within the scope of the invention.

In another embodiment, an isolated nucleic acid molecule of the invention is at least 7, 15, 20, 25, 30, 40, 60, 80, 100, 150, 200, 250, 300, 350, 400, 450, 550, 650, 700, 800, 900, 1000, 1200, 1400, 1600, 1800, 2000, 2200, 2400, 2600, 2800, 3000, 3500, 4000, 4500, or more nucleotides in length and hybridizes under stringent conditions to a marker nucleic acid or to a nucleic acid encoding a marker protein. As used herein, the term "hybridizes under stringent conditions" is intended to describe conditions for hybridization and washing under which nucleotide sequences at least 60% (65%, 70%, preferably 75%) identical to each other typically remain hybridized to each other. Such stringent conditions are known to those skilled in the art and can be found in sections 6.3.1-6.3.6 of *Current Protocols in Molecular Biology*, John Wiley & Sons, N.Y. (1989). A preferred, non-limiting example of stringent hybridization conditions are hybridization in 6× sodium chloride/sodium citrate (SSC) at about 45° C., followed by one or more washes in 0.2×SSC, 0.1% SDS at 50-65° C.

In addition to naturally-occurring allelic variants of a nucleic acid molecule of the invention that can exist in the population, the skilled artisan will further appreciate that sequence changes can be introduced by mutation thereby leading to changes in the amino acid sequence of the encoded protein, without altering the biological activity of the protein encoded thereby. For example, one can make nucleotide substitutions leading to amino acid substitutions at "non-essential" amino acid residues. A "non-essential" amino acid residue is a residue that can be altered from the wild-type sequence without altering the biological activity, whereas an "essential" amino acid residue is required for biological activity. For example, amino acid residues that are not conserved or only semi-conserved among homologs of various species may be non-essential for activity and thus would be likely targets for alteration. Alternatively, amino acid residues that are conserved among the homologs of various species (e.g., murine and human) may be essential for activity and thus would not be likely targets for alteration.

Accordingly, another aspect of the invention pertains to nucleic acid molecules encoding a variant marker protein that contain changes in amino acid residues that are not essential for activity. Such variant marker proteins differ in amino acid sequence from the naturally-occurring marker proteins, yet retain biological activity. In one embodiment, such a variant marker protein has an amino acid sequence that is at least about 40% identical, 50%, 60%, 70%, 80%, 90%, 91%, 92%, 93%, 94%, 95%, 96%, 97%, 98% or 99% identical to the amino acid sequence of a marker protein.

An isolated nucleic acid molecule encoding a variant marker protein can be created by introducing one or more nucleotide substitutions, additions or deletions into the nucleotide sequence of marker nucleic acids, such that one or more amino acid residue substitutions, additions, or deletions are introduced into the encoded protein. Mutations can be introduced by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), non-polar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity. Following mutagenesis, the encoded protein can be expressed recombinantly and the activity of the protein can be determined.

The present invention encompasses antisense nucleic acid molecules, i.e., molecules which are complementary to a sense nucleic acid of the invention, e.g., complementary to the coding strand of a double-stranded marker cDNA molecule or complementary to a marker mRNA sequence. Accordingly, an antisense nucleic acid of the invention can hydrogen bond to (i.e. anneal with) a sense nucleic acid of the invention. The antisense nucleic acid can be complementary to an entire coding strand, or to only a portion thereof, e.g., all or part of the protein coding region (or open reading frame). An antisense nucleic acid molecule can also be antisense to all or part of a non-coding region of the coding strand of a nucleotide sequence encoding a marker protein. The non-coding regions ("5' and 3' untranslated regions") are the 5' and 3' sequences which flank the coding region and are not translated into amino acids.

An antisense oligonucleotide can be, for example, about 5, 10, 15, 20, 25, 30, 35, 40, 45, or 50 or more nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl)uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3)w, and 2,6-diaminopurine. Alternatively, the antisense nucleic acid can be produced biologically using an expression vector into which a nucleic acid has been sub-cloned in an antisense orientation (i.e., RNA transcribed from the inserted nucleic acid will be of an antisense orientation to a target nucleic acid of interest, described further in the following subsection).

As used herein, a "nucleic acid" inhibitor is any nucleic acid based inhibitor that causes a decrease in the expression of the target by hybridizing with at least a portion of the RNA transcript from the target gene to result in a decrease in the expression of target. Nucleic acid inhibitors include, for example, single stranded nucleic acid molecules, e.g., antisense nucleic acids, and double stranded nucleic acids such as siRNA, shRNA, dsiRNA (see, e.g., US Patent publication 20070104688). As used herein, double stranded nucleic acid molecules are designed to be double stranded over at least 12, preferably at least 15 nucleotides. Double stranded nucleic acid molecules can be a single nucleic acid strand designed to hybridize to itself, e.g., an shRNA. It is understood that a nucleic acid inhibitor of target can be administered as an isolated nucleic acid. Alternatively, the nucleic acid inhibitor can be administered as an expression construct to produce the inhibitor in the cell. In certain embodiments, the nucleic acid inhibitor includes one or more chemical modifications to improve the activity and/or stability of the nucleic acid inhibitor. Such modifications are well known in the art. The specific modifications to be used will depend, for example, on the type of nucleic acid inhibitor.

Antisense nucleic acid therapeutic agent single stranded nucleic acid therapeutics, typically about 16 to 30 nucleotides in length and are complementary to a target nucleic acid sequence in the target cell, either in culture or in an organism.

Patents directed to antisense nucleic acids, chemical modifications, and therapeutic uses are provided, for example, in U.S. Pat. No. 5,898,031 related to chemically modified RNA-containing therapeutic compounds, and U.S. Pat. No. 6,107,094 related methods of using these compounds as therapeutic agent. U.S. Pat. No. 7,432,250 related to methods of treating patients by administering single-stranded chemically modified RNA-like compounds; and U.S. Pat. No. 7,432,249 related to pharmaceutical compositions containing single-stranded chemically modified RNA-like compounds. U.S. Pat. No. 7,629,321 is related to methods of cleaving target mRNA using a single-stranded oligonucleotide having a plurality RNA nucleosides and at least one chemical modification. Each of the patents listed in the paragraph are incorporated herein by reference.

In many embodiments, the duplex region is 15-30 nucleotide pairs in length. In some embodiments, the duplex region is 17-23 nucleotide pairs in length, 17-25 nucleotide pairs in length, 23-27 nucleotide pairs in length, 19-21 nucleotide pairs in length, or 21-23 nucleotide pairs in length.

In certain embodiments, each strand has 15-30 nucleotides.

The RNAi agents that can be used in the methods of the invention include agents with chemical modifications as disclosed, for example, in U.S. Provisional Application No. 61/561,710, filed on Nov. 18, 2011, International Application No. PCT/US2011/051597, filed on Sep. 15, 2010, and PCT Publication WO 2009/073809, the entire contents of each of which are incorporated herein by reference.

An "RNAi agent," "double stranded RNAi agent," double-stranded RNA (dsRNA) molecule, also referred to as "dsRNA agent," "dsRNA", "siRNA", "iRNA agent," as used interchangeably herein, refers to a complex of ribonucleic acid molecules, having a duplex structure comprising two anti-parallel and substantially complementary, as defined below, nucleic acid strands. As used herein, an RNAi agent can also include dsiRNA (see, e.g., US Patent publication 20070104688, incorporated herein by reference). In general, the majority of nucleotides of each strand are ribonucleotides, but as described herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. Such modifications may include all types of modifications disclosed herein or known in the art. Any such modifications, as used in a siRNA type molecule, are encompassed by "RNAi agent" for the purposes of this specification and claims.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi agent may comprise one or more nucleotide overhangs. The term "siRNA" is also used herein to refer to an RNAi agent as described above.

In another aspect, the agent is a single-stranded antisense RNA molecule. An antisense RNA molecule is complementary to a sequence within the target mRNA. Antisense RNA can inhibit translation in a stoichiometric manner by base pairing to the mRNA and physically obstructing the translation machinery, see Dias, N. et al., (2002) Mol Cancer Ther 1:347-355. The antisense RNA molecule may have about 15-30 nucleotides that are complementary to the target mRNA. For example, the antisense RNA molecule may have a sequence of at least 15, 16, 17, 18, 19, 20 or more contiguous nucleotides from one of the antisense sequences of Table 1.

The term "antisense strand" refers to the strand of a double stranded RNAi agent which includes a region that is substantially complementary to a target sequence. As used herein, the term "region complementary to part of an mRNA encoding" a protein of interest refers to a region on the antisense strand that is substantially complementary to part of a target mRNA sequence encoding the protein. Where the region of complementarity is not fully complementary to the target sequence, the mismatches are most tolerated in the terminal regions and, if present, are generally in a terminal region or regions, e.g., within 6, 5, 4, 3, or 2 nucleotides of the 5' and/or 3' terminus.

The term "sense strand," as used herein, refers to the strand of a dsRNA that includes a region that is substantially complementary to a region of the antisense strand.

In various embodiments, the nucleic acid molecules of the invention can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids (see Hyrup et al., 1996, *Bioorganic & Medicinal Chemistry* 4(1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996), supra; Perry-O'Keefe et al. (1996) *Proc. Natl. Acad. Sci. USA* 93:14670-675.

PNAs can be used in therapeutic and diagnostic applications. For example, PNAs can be used as antisense or antigene agents for sequence-specific modulation of gene expression by, e.g., inducing transcription or translation arrest or inhibiting replication. PNAs can also be used, e.g., in the analysis of single base pair mutations in a gene by, e.g., PNA directed PCR clamping; as artificial restriction enzymes when used in combination with other enzymes, e.g., S1 nucleases (Hyrup (1996), supra; or as probes or primers for DNA sequence and hybridization (Hyrup, 1996, supra; Perry-O'Keefe et al., 1996, *Proc. Natl. Acad. Sci. USA* 93:14670-675).

In another embodiment, PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which can combine the advantageous properties of PNA and DNA. Such chimeras allow DNA recognition enzymes, e.g., RNase H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup, 1996, supra). The synthesis of PNA-DNA chimeras can be performed as described in Hyrup (1996), supra, and Finn et al. (1996) *Nucleic Acids Res.* 24(17):3357-63. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al., 1989, *Nucleic Acids Res.* 17:5973-88). PNA monomers are then coupled in a step-wise manner to produce a chimeric molecule with a 5' PNA segment and a 3' DNA segment (Finn et al., 1996, *Nucleic Acids Res.* 24(17):3357-63). Alternatively, chimeric molecules can be synthesized with a 5' DNA segment and a 3' PNA segment (Peterser et al., 1975, *Bioorganic Med. Chem. Lett.* 5:1119-11124).

In other embodiments, the oligonucleotide can include other appended groups such as peptides (e.g., for targeting host cell receptors in vivo), or agents facilitating transport across the cell membrane (see, e.g., Letsinger et al., 1989, *Proc. Natl. Acad. Sci. USA* 86:6553-6556; Lemaitre et al., 1987, *Proc. Natl. Acad. Sci. USA* 84:648-652; PCT Publication No. WO 88/09810) or the blood-brain bather (see, e.g., PCT Publication No. WO 89/10134). In addition, oligonucleotides can be modified with hybridization-triggered cleavage agents (see, e.g., Krol et al., 1988, *Bio/Techniques* 6:958-976) or intercalating agents (see, e.g., Zon, 1988, *Pharm. Res.* 5:539-549). To this end, the oligonucleotide can be conjugated to another molecule, e.g., a peptide, hybridization triggered cross-linking agent, transport agent, hybridization-triggered cleavage agent, etc.

The invention also includes molecular beacon nucleic acids having at least one region which is complementary to a nucleic acid of the invention, such that the molecular beacon is useful for quantitating the presence of the nucleic acid of the invention in a sample. A "molecular beacon" nucleic acid is a nucleic acid comprising a pair of complementary regions and having a fluorophore and a fluorescent quencher associated therewith. The fluorophore and quencher are associated with different portions of the nucleic acid in such an orientation that when the complementary regions are annealed with one another, fluorescence of the fluorophore is quenched by the quencher. When the complementary regions of the nucleic acid are not annealed with one another, fluorescence of the fluorophore is quenched to a lesser degree. Molecular beacon nucleic acids are described, for example, in U.S. Pat. No. 5,876,930.

D. Isolated Proteins and Antibodies

One aspect of the invention pertains to isolated marker proteins and biologically active portions thereof, as well as polypeptide fragments suitable for use as immunogens to raise antibodies directed against a marker protein or a fragment thereof. In one embodiment, the native marker protein can be isolated from cells or tissue sources by an appropriate purification scheme using standard protein purification techniques. In another embodiment, a protein or peptide comprising the whole or a segment of the marker protein is produced by recombinant DNA techniques. Alternative to recombinant expression, such protein or peptide can be synthesized chemically using standard peptide synthesis techniques.

An "isolated" or "purified" protein or biologically active portion thereof is substantially free of cellular material or other contaminating proteins from the cell or tissue source from which the protein is derived, or substantially free of chemical precursors or other chemicals when chemically synthesized. The language "substantially free of cellular material" includes preparations of protein in which the protein is separated from cellular components of the cells from which it is isolated or recombinantly produced. Thus, protein that is substantially free of cellular material includes preparations of protein having less than about 30%, 20%, 10%, or 5% (by dry weight) of heterologous protein (also referred to herein as a "contaminating protein"). When the protein or biologically active portion thereof is recombinantly produced, it is also preferably substantially free of culture medium, i.e., culture medium represents less than about 20%, 10%, or 5% of the volume of the protein preparation. When the protein is produced by chemical synthesis, it is preferably substantially free of chemical precursors or other chemicals, i.e., it is separated from chemical precursors or other chemicals which are involved in the synthesis of the protein. Accordingly such preparations of the protein have less than about 30%, 20%, 10%, 5% (by dry weight) of chemical precursors or compounds other than the polypeptide of interest.

Biologically active portions of a marker protein include polypeptides comprising amino acid sequences sufficiently identical to or derived from the amino acid sequence of the marker protein, which include fewer amino acids than the full length protein, and exhibit at least one activity of the corresponding full-length protein. Typically, biologically active portions comprise a domain or motif with at least one activity of the corresponding full-length protein. A biologically active portion of a marker protein of the invention can be a polypeptide which is, for example, 10, 25, 50, 100 or more amino acids in length. Moreover, other biologically active portions, in which other regions of the marker protein are deleted, can be prepared by recombinant techniques and evaluated for one or more of the functional activities of the native form of the marker protein.

Preferred marker proteins are encoded by nucleotide sequences comprising the sequences encoding any of the genes described in the examples. Other useful proteins are substantially identical (e.g., at least about 40%, preferably 50%, 60%, 70%, 80%, 90%, 91%, 92%, 93%, 94%, 95%, 96%, 97%, 98% or 99%) to one of these sequences and retain the functional activity of the corresponding naturally-occurring marker protein yet differ in amino acid sequence due to natural allelic variation or mutagenesis.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. Preferably, the percent identity between the two sequences is calculated using a global alignment. Alternatively, the percent identity between the two sequences is calculated using a local alignment. The percent identity between the two sequences is a function of the number of identical positions shared by the sequences (i.e., % identity=# of identical positions/total # of positions (e.g., overlapping positions)×100). In one embodiment the two sequences are the same length. In another embodiment, the two sequences are not the same length.

The determination of percent identity between two sequences can be accomplished using a mathematical algorithm. A preferred, non-limiting example of a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the BLASTN and BLASTX programs of Altschul, et al. (1990) *J. Mol. Biol.* 215:403-410. BLAST nucleotide searches can be performed with the BLASTN program, score=100, wordlength=12 to obtain nucleotide sequences homologous to a nucleic acid molecules of the invention. BLAST protein searches can be performed with the BLASTP program, score=50, wordlength=3 to obtain amino acid sequences homologous to a protein molecules of the invention. To obtain gapped alignments for comparison purposes, a newer version of the BLAST algorithm called Gapped BLAST can be utilized as described in Altschul et al. (1997) *Nucleic Acids Res.* 25:3389-3402, which is able to perform gapped local alignments for the programs BLASTN, BLASTP and BLASTX. Alternatively, PSI-Blast can be used to perform an iterated search which detects distant relationships between molecules. When utilizing BLAST, Gapped BLAST, and PSI-Blast programs, the default parameters of the respective programs (e.g., BLASTX and BLASTN) can be used. See http://www.ncbi.nlm.nih.gov. Another preferred, non-limiting example of a mathematical algorithm utilized for the comparison of sequences is the algorithm of Myers and Miller, (1988) *CABIOS* 4:11-17. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Yet another useful algorithm for identifying regions of local sequence similarity and alignment is the FASTA algorithm as described in Pearson and Lipman (1988) *Proc. Natl. Acad. Sci. USA* 85:2444-2448. When using the FASTA algorithm for comparing nucleotide or amino acid sequences, a PAM120 weight residue table can, for example, be used with a k-tuple value of 2.

The percent identity between two sequences can be determined using techniques similar to those described above, with or without allowing gaps. In calculating percent identity, only exact matches are counted.

The invention also provides chimeric or fusion proteins comprising a marker protein or a segment thereof. As used herein, a "chimeric protein" or "fusion protein" comprises all or part (preferably a biologically active part) of a marker protein operably linked to a heterologous polypeptide (i.e., a polypeptide other than the marker protein). Within the fusion protein, the term "operably linked" is intended to indicate that the marker protein or segment thereof and the heterologous polypeptide are fused in-frame to each other. The heterologous polypeptide can be fused to the amino-terminus or the carboxyl-terminus of the marker protein or segment.

One useful fusion protein is a GST fusion protein in which a marker protein or segment is fused to the carboxyl terminus of GST sequences. Such fusion proteins can facilitate the purification of a recombinant polypeptide of the invention.

In another embodiment, the fusion protein contains a heterologous signal sequence at its amino terminus. For example, the native signal sequence of a marker protein can be removed and replaced with a signal sequence from another protein. For example, the gp67 secretory sequence of the baculovirus envelope protein can be used as a heterologous signal sequence (Ausubel et al., ed., *Current Protocols in Molecular Biology*, John Wiley & Sons, NY, 1992). Other examples of eukaryotic heterologous signal sequences include the secretory sequences of melittin and human placental alkaline phosphatase (Stratagene; La Jolla, Calif.). In yet another example, useful prokaryotic heterologous signal sequences include the phoA secretory signal (Sambrook et al., supra) and the protein A secretory signal (Pharmacia Biotech; Piscataway, N.J.).

In yet another embodiment, the fusion protein is an immunoglobulin fusion protein in which all or part of a marker protein is fused to sequences derived from a member of the immunoglobulin protein family. The immunoglobulin fusion proteins of the invention can be incorporated into pharmaceutical compositions and administered to a subject to inhibit an interaction between a ligand (soluble or membrane-bound) and a protein on the surface of a cell (receptor), to thereby suppress signal transduction in vivo. The immunoglobulin fusion protein can be used to affect the bioavailability of a cognate ligand of a marker protein. Inhibition of ligand/receptor interaction can be useful therapeutically, both for treating proliferative and differentiative disorders and for modulating (e.g. promoting or inhibiting) cell survival. Moreover, the immunoglobulin fusion proteins of the invention can be used as immunogens to produce antibodies directed against a marker protein in a subject, to purify ligands and in screening assays to identify molecules which inhibit the interaction of the marker protein with ligands.

Chimeric and fusion proteins of the invention can be produced by standard recombinant DNA techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see, e.g., Ausubel et al., supra). Moreover, many expression vectors are commercially available that already encode a fusion moiety (e.g., a GST polypeptide). A nucleic acid encoding a polypeptide of the invention can be cloned into such an expression vector such that the fusion moiety is linked in-frame to the polypeptide of the invention.

A signal sequence can be used to facilitate secretion and isolation of marker proteins. Signal sequences are typically characterized by a core of hydrophobic amino acids which are generally cleaved from the mature protein during secretion in one or more cleavage events. Such signal peptides contain processing sites that allow cleavage of the signal sequence from the mature proteins as they pass through the secretory pathway. Thus, the invention pertains to marker proteins, fusion proteins or segments thereof having a signal sequence, as well as to such proteins from which the signal sequence has been proteolytically cleaved (i.e., the cleavage products). In one embodiment, a nucleic acid sequence encoding a signal sequence can be operably linked in an expression vector to a protein of interest, such as a marker protein or a segment thereof. The signal sequence directs secretion of the protein, such as from a eukaryotic host into which the expression vector is transformed, and the signal sequence is subsequently or concurrently cleaved. The protein can then be readily purified from the extracellular medium by art recognized methods. Alternatively, the signal sequence can be linked to the protein of interest using a sequence which facilitates purification, such as with a GST domain.

The present invention also pertains to variants of the marker proteins. Such variants have an altered amino acid sequence which can function as either agonists (mimetics) or as antagonists. Variants can be generated by mutagenesis, e.g., discrete point mutation or truncation. An agonist can retain substantially the same, or a subset, of the biological activities of the naturally occurring form of the protein. An antagonist of a protein can inhibit one or more of the activities of the naturally occurring form of the protein by, for example, competitively binding to a downstream or upstream member of a cellular signaling cascade which includes the protein of interest. Thus, specific biological effects can be elicited by treatment with a variant of limited function. Treatment of a subject with a variant having a subset of the biological activities of the naturally occurring form of the protein can have fewer side effects in a subject relative to treatment with the naturally occurring form of the protein.

Variants of a marker protein which function as either agonists (mimetics) or as antagonists can be identified by screening combinatorial libraries of mutants, e.g., truncation mutants, of the protein of the invention for agonist or antagonist activity. In one embodiment, a variegated library of variants is generated by combinatorial mutagenesis at the nucleic acid level and is encoded by a variegated gene library. A variegated library of variants can be produced by, for example, enzymatically ligating a mixture of synthetic oligonucleotides into gene sequences such that a degenerate set of potential protein sequences is expressible as individual polypeptides, or alternatively, as a set of larger fusion proteins (e.g., for phage display). There are a variety of methods which can be used to produce libraries of potential variants of the marker proteins from a degenerate oligonucleotide sequence. Methods for synthesizing degenerate oligonucleotides are known in the art (see, e.g., Narang, 1983, *Tetrahedron* 39:3; Itakura et al., 1984, *Annu. Rev. Biochem.* 53:323; Itakura et al., 1984, *Science* 198:1056; Ike et al., 1983 *Nucleic Acid Res.* 11:477).

In addition, libraries of segments of a marker protein can be used to generate a variegated population of polypeptides for screening and subsequent selection of variant marker proteins or segments thereof. For example, a library of coding sequence fragments can be generated by treating a double stranded PCR fragment of the coding sequence of interest with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes amino terminal and internal fragments of various sizes of the protein of interest.

Several techniques are known in the art for screening gene products of combinatorial libraries made by point mutations or truncation, and for screening cDNA libraries for gene products having a selected property. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique which enhances the frequency of functional mutants in the libraries, can be used in combination with the screening assays to identify variants of a protein of the invention (Arkin and Yourvan, 1992, *Proc. Natl. Acad. Sci. USA* 89:7811-7815; Delgrave et al., 1993, *Protein Engineering* 6(3):327-331).

Another aspect of the invention pertains to antibodies directed against a protein of the invention. In preferred embodiments, the antibodies specifically bind a marker protein or a fragment thereof. The terms "antibody" and "antibodies" as used interchangeably herein refer to immunoglobulin molecules as well as fragments and derivatives thereof that comprise an immunologically active portion of an immunoglobulin molecule, (i.e., such a portion contains an antigen binding site which specifically binds an antigen, such as a marker protein, e.g., an epitope of a marker protein). An antibody which specifically binds to a protein of the invention is an antibody which binds the protein, but does not substantially bind other molecules in a sample, e.g., a biological sample, which naturally contains the protein. Examples of an immunologically active portion of an immunoglobulin molecule include, but are not limited to, single-chain antibodies (scAb), F(ab) and F(ab')$_2$ fragments.

An isolated protein of the invention or a fragment thereof can be used as an immunogen to generate antibodies. The full-length protein can be used or, alternatively, the invention provides antigenic peptide fragments for use as immunogens. The antigenic peptide of a protein of the invention comprises at least 8 (preferably 10, 15, 20, or 30 or more) amino acid residues of the amino acid sequence of one of the proteins of the invention, and encompasses at least one epitope of the protein such that an antibody raised against the peptide forms a specific immune complex with the protein. Preferred epitopes encompassed by the antigenic peptide are regions that are located on the surface of the protein, e.g., hydrophilic regions. Hydrophobicity sequence analysis, hydrophilicity sequence analysis, or similar analyses can be used to identify hydrophilic regions. In preferred embodiments, an isolated marker protein or fragment thereof is used as an immunogen.

An immunogen typically is used to prepare antibodies by immunizing a suitable (i.e. immunocompetent) subject such as a rabbit, goat, mouse, or other mammal or vertebrate. An appropriate immunogenic preparation can contain, for example, recombinantly-expressed or chemically-synthesized protein or peptide. The preparation can further include an adjuvant, such as Freund's complete or incomplete adjuvant, or a similar immunostimulatory agent. Preferred immunogen compositions are those that contain no other human proteins such as, for example, immunogen compositions made using a non-human host cell for recombinant expression of a protein of the invention. In such a manner, the resulting antibody compositions have reduced or no binding of human proteins other than a protein of the invention.

The invention provides polyclonal and monoclonal antibodies. The term "monoclonal antibody" or "monoclonal antibody composition", as used herein, refers to a population of antibody molecules that contain only one species of an antigen binding site capable of immunoreacting with a particular epitope. Preferred polyclonal and monoclonal antibody compositions are ones that have been selected for antibodies directed against a protein of the invention. Particularly preferred polyclonal and monoclonal antibody preparations are ones that contain only antibodies directed against a marker protein or fragment thereof.

Polyclonal antibodies can be prepared by immunizing a suitable subject with a protein of the invention as an immunogen. The antibody titer in the immunized subject can be monitored over time by standard techniques, such as with an enzyme linked immunosorbent assay (ELISA) using immobilized polypeptide. At an appropriate time after immunization, e.g., when the specific antibody titers are highest, antibody-producing cells can be obtained from the subject and used to prepare monoclonal antibodies (mAb) by standard techniques, such as the hybridoma technique originally described by Kohler and Milstein (1975) *Nature* 256:495-497, the human B cell hybridoma technique (see Kozbor et al., 1983, *Immunol. Today* 4:72), the EBV-hybridoma technique (see Cole et al., pp. 77-96 In *Monoclonal Antibodies* and *Cancer Therapy*, Alan R. Liss, Inc., 1985) or trioma techniques. The technology for producing hybridomas is well known (see generally *Current Protocols in Immunology*, Coligan et al. ed., John Wiley & Sons, New York, 1994). Hybridoma cells producing a monoclonal antibody of the invention are detected by screening the hybridoma culture supernatants for antibodies that bind the polypeptide of interest, e.g., using a standard ELISA assay.

Alternative to preparing monoclonal antibody-secreting hybridomas, a monoclonal antibody directed against a protein of the invention can be identified and isolated by screening a recombinant combinatorial immunoglobulin library (e.g., an antibody phage display library) with the polypeptide of interest. Kits for generating and screening phage display libraries are commercially available (e.g., the Pharmacia *Recombinant Phage Antibody System*, Catalog No. 27-9400-01; and the Stratagene *SurfZAP Phage Display Kit*, Catalog No. 240612). Additionally, examples of methods and reagents particularly amenable for use in generating and screening antibody display library can be found in, for example, U.S. Pat. No. 5,223,409; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al. (1991) *Bio/Technology* 9:1370-1372; Hay et al. (1992) *Hum. Antibod. Hybridomas* 3:81-85; Huse et al. (1989) *Science* 246:1275-1281; Griffiths et al. (1993) *EMBO J.* 12:725-734.

The invention also provides recombinant antibodies that specifically bind a protein of the invention. In preferred embodiments, the recombinant antibodies specifically binds a marker protein or fragment thereof. Recombinant antibodies include, but are not limited to, chimeric and humanized monoclonal antibodies, comprising both human and non-human portions, single-chain antibodies and multi-specific antibodies. A chimeric antibody is a molecule in which different portions are derived from different animal species, such as those having a variable region derived from a murine mAb and a human immunoglobulin constant region. (See, e.g., Cabilly et al., U.S. Pat. No. 4,816,567; and Boss et al., U.S. Pat. No. 4,816,397, which are incorporated herein by reference in their entirety.) Single-chain antibodies have an antigen binding site and consist of a single polypeptide. They can be produced by techniques known in the art, for example using methods described in Ladner et. al U.S. Pat. No. 4,946,778 (which is incorporated herein by reference in its entirety); Bird et al., (1988) *Science* 242:423-426; Whitlow et al., (1991) *Methods in Enzymology* 2:1-9; Whitlow et al., (1991) *Methods in Enzymology* 2:97-105; and Huston et al., (1991) *Methods in Enzymology Molecular Design and Modeling: Concepts and Applications* 203:46-88. Multi-specific antibodies are antibody molecules having at least two antigen-binding sites that specifically bind different antigens. Such molecules can be produced by techniques known in the art, for example using methods described in Segal, U.S. Pat. No. 4,676,980 (the disclosure of which is incorporated herein by reference in its entirety); Holliger et al., (1993) *Proc. Natl. Acad. Sci. USA* 90:6444-6448; Whitlow et al., (1994) *Protein Eng.* 7:1017-1026 and U.S. Pat. No. 6,121,424.

Humanized antibodies are antibody molecules from non-human species having one or more complementarity determining regions (CDRs) from the non-human species and a framework region from a human immunoglobulin molecule. (See, e.g., Queen, U.S. Pat. No. 5,585,089, which is incorporated herein by reference in its entirety.) Humanized monoclonal antibodies can be produced by recombinant DNA techniques known in the art, for example using methods described in PCT Publication No. WO 87/02671; European Patent Application 184,187; European Patent Application 171,496; European Patent Application 173,494; PCT Publication No. WO 86/01533; U.S. Pat. No. 4,816,567; European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Cancer Res.* 47:999-1005; Wood et al. (1985) *Nature* 314:446-449; and Shaw et al. (1988) *J. Natl. Cancer Inst.* 80:1553-1559); Morrison (1985) *Science* 229:1202-1207; Oi et al. (1986) *Bio/Techniques* 4:214; U.S. Pat. No. 5,225,539; Jones et al. (1986) *Nature* 321:552-525; Verhoeyan et al. (1988) *Science* 239:1534; and Beidler et al. (1988) *J. Immunol.* 141:4053-4060.

More particularly, humanized antibodies can be produced, for example, using transgenic mice which are incapable of expressing endogenous immunoglobulin heavy and light chains genes, but which can express human heavy and light chain genes. The transgenic mice are immunized in the normal fashion with a selected antigen, e.g., all or a portion of a polypeptide corresponding to a marker of the invention. Monoclonal antibodies directed against the antigen can be obtained using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA and IgE antibodies. For an overview of this technology for producing human antibodies, see Lonberg and Huszar (1995) *Int. Rev. Immunol.* 13:65-93). For a detailed discussion of this technology for producing human antibodies and human monoclonal antibodies and protocols for producing such antibodies, see, e.g., U.S. Pat. No. 5,625,126; U.S. Pat. No. 5,633,425; U.S. Pat. No. 5,569,825; U.S. Pat. No. 5,661,016; and U.S. Pat. No. 5,545,806. In addition, companies such as Abgenix, Inc. (Freemont, Calif.), can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a murine antibody, is used to guide the selection of a completely human antibody recognizing the same epitope (Jespers et al., 1994, *Bio/technology* 12:899-903).

The antibodies of the invention can be isolated after production (e.g., from the blood or serum of the subject) or synthesis and further purified by well-known techniques. For example, IgG antibodies can be purified using protein A chromatography. Antibodies specific for a protein of the invention can be selected or (e.g., partially purified) or purified by, e.g., affinity chromatography. For example, a recombinantly expressed and purified (or partially purified) protein of the invention is produced as described herein, and covalently or non-covalently coupled to a solid support such as, for example, a chromatography column. The column can then be used to affinity purify antibodies specific for the proteins of the invention from a sample containing antibodies directed against a large number of different epitopes, thereby generating a substantially purified antibody composition, i.e., one that is substantially free of contaminating antibodies. By a substantially purified antibody composition is meant, in this context, that the antibody sample contains at most only 30% (by dry weight) of contaminating antibodies directed against epitopes other than those of the desired protein of the invention, and preferably at most 20%, yet more preferably at most 10%, and most preferably at most 5% (by dry weight) of the sample is contaminating antibodies. A purified antibody composition means that at least 99% of the antibodies in the composition are directed against the desired protein of the invention.

In a preferred embodiment, the substantially purified antibodies of the invention may specifically bind to a signal peptide, a secreted sequence, an extracellular domain, a transmembrane or a cytoplasmic domain or cytoplasmic membrane of a protein of the invention. In a particularly preferred embodiment, the substantially purified antibodies of the invention specifically bind to a secreted sequence or an extracellular domain of the amino acid sequences of a protein of the invention. In a more preferred embodiment, the substantially purified antibodies of the invention specifically bind to a secreted sequence or an extracellular domain of the amino acid sequences of a marker protein.

An antibody directed against a protein of the invention can be used to isolate the protein by standard techniques, such as affinity chromatography or immunoprecipitation. Moreover, such an antibody can be used to detect the marker protein or fragment thereof (e.g., in a cellular lysate or cell supernatant) in order to evaluate the level and pattern of expression of the marker. The antibodies can also be used diagnostically to monitor protein levels in tissues or body fluids (e.g. in disease state or toxicity state associated body fluid) as part of a clinical testing procedure, e.g., to, for example, determine the efficacy of a given treatment regimen. Detection can be facilitated by the use of an antibody derivative, which comprises an antibody of the invention coupled to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $$^{125}I, \ ^{131}I, \ ^{35}S \text{ or } ^{3}H.$$

Antibodies of the invention may also be used as therapeutic agents in treating cancers. In a preferred embodiment, completely human antibodies of the invention are used for therapeutic treatment of human cancer patients, particularly those having a cancer. In another preferred embodiment, antibodies that bind specifically to a marker protein or fragment thereof are used for therapeutic treatment. Further, such therapeutic antibody may be an antibody derivative or immunotoxin comprising an antibody conjugated to a therapeutic moiety such as a cytotoxin, a therapeutic agent or a radioactive metal ion. A cytotoxin or cytotoxic agent includes any agent that is detrimental to cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

The conjugated antibodies of the invention can be used for modifying a given biological response, for the drug moiety is not to be construed as limited to classical chemical therapeutic agents. For example, the drug moiety may be a protein or polypeptide possessing a desired biological activity. Such proteins may include, for example, a toxin such as ribosome-inhibiting protein (see Better et al., U.S. Pat. No. 6,146,631, the disclosure of which is incorporated herein in its entirety), abrin, ricin A, pseudomonas exotoxin, or diphtheria toxin; a protein such as tumor necrosis factor, .alpha.-interferon, β-interferon, nerve growth factor, platelet derived growth factor, tissue plasminogen activator; or, biological response modifiers such as, for example, lymphokines, interleukin-1 ("IL-1"), interleukin-2 ("IL-2"), interleukin-6 ("IL-6"), granulocyte macrophase colony stimulating factor ("GM-CSF"), granulocyte colony stimulating factor ("G-CSF"), or other growth factors.

Techniques for conjugating such therapeutic moiety to antibodies are well known, see, e.g., Amon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", Immunol. Rev., 62:119-58 (1982).

Accordingly, in one aspect, the invention provides substantially purified antibodies, antibody fragments and derivatives, all of which specifically bind to a protein of the invention and preferably, a marker protein. In various embodiments, the substantially purified antibodies of the invention, or fragments or derivatives thereof, can be human, non-human, chimeric and/or humanized antibodies. In another aspect, the invention provides non-human antibodies, antibody fragments and derivatives, all of which specifically bind to a protein of the invention and preferably, a marker protein. Such non-human antibodies can be goat, mouse, sheep, horse, chicken, rabbit, or rat antibodies. Alternatively, the non-human antibodies of the invention can be chimeric and/or humanized antibodies. In addition, the non-human antibodies of the invention can be polyclonal antibodies or monoclonal antibodies. In still a further aspect, the invention provides monoclonal antibodies, antibody fragments and derivatives, all of which specifically bind to a protein of the invention and preferably, a marker protein. The monoclonal antibodies can be human, humanized, chimeric and/or non-human antibodies.

The invention also provides a kit containing an antibody of the invention conjugated to a detectable substance, and instructions for use. Still another aspect of the invention is a pharmaceutical composition comprising an antibody of the invention. In one embodiment, the pharmaceutical composition comprises an antibody of the invention and a pharmaceutically acceptable carrier.

E. Predictive Medicine

The present invention pertains to the field of predictive medicine in which diagnostic assays, prognostic assays, pharmacogenomics, and monitoring clinical trails are used for prognostic (predictive) purposes to thereby treat an individual prophylactically. Accordingly, one aspect of the present invention relates to diagnostic assays for determining the level of expression of one or more marker proteins or nucleic acids, in order to determine whether an individual is at risk of developing certain disease or drug-induced toxicity. Such assays can be used for prognostic or predictive purposes to thereby prophylactically treat an individual prior to the onset of the disorder.

Yet another aspect of the invention pertains to monitoring the influence of agents (e.g., drugs or other compounds administered either to inhibit or to treat or prevent a disorder or drug-induced toxicity {i.e. in order to understand any drug-induced toxic effects that such treatment may have}) on the expression or activity of a marker of the invention in clinical trials. These and other agents are described in further detail in the following sections.

F. Diagnostic Assays

An exemplary method for detecting the presence or absence of a marker protein or nucleic acid in a biological sample involves obtaining a biological sample (e.g. toxicity-associated body fluid or tissue sample) from a test subject and contacting the biological sample with a compound or an agent capable of detecting the polypeptide or nucleic acid (e.g., mRNA, genomic DNA, or cDNA). The detection methods of the invention can thus be used to detect mRNA, protein, cDNA, or genomic DNA, for example, in a biological sample in vitro as well as in vivo. For example, in vitro techniques for detection of mRNA include Northern hybridizations and in situ hybridizations. In vitro techniques for detection of a marker protein include enzyme linked immunosorbent assays (ELISAs), Western blots, immunoprecipitations and immunofluorescence. In vitro techniques for detection of genomic DNA include Southern hybridizations. In vivo techniques for detection of mRNA include polymerase chain reaction (PCR), Northern hybridizations and in situ hybridizations. Furthermore, in vivo techniques for detection of a marker protein include introducing into a subject a labeled antibody directed against the protein or fragment thereof. For example, the antibody can be labeled with a radioactive marker whose presence and location in a subject can be detected by standard imaging techniques.

A general principle of such diagnostic and prognostic assays involves preparing a sample or reaction mixture that may contain a marker, and a probe, under appropriate conditions and for a time sufficient to allow the marker and probe to interact and bind, thus forming a complex that can be removed and/or detected in the reaction mixture. These assays can be conducted in a variety of ways.

For example, one method to conduct such an assay would involve anchoring the marker or probe onto a solid phase support, also referred to as a substrate, and detecting target marker/probe complexes anchored on the solid phase at the end of the reaction. In one embodiment of such a method, a sample from a subject, which is to be assayed for presence and/or concentration of marker, can be anchored onto a carrier or solid phase support. In another embodiment, the reverse situation is possible, in which the probe can be anchored to a solid phase and a sample from a subject can be allowed to react as an unanchored component of the assay.

There are many established methods for anchoring assay components to a solid phase. These include, without limitation, marker or probe molecules which are immobilized through conjugation of biotin and streptavidin. Such biotinylated assay components can be prepared from biotin-NHS (N-hydroxy-succinimide) using techniques known in the art (e.g., biotinylation kit, Pierce Chemicals, Rockford, Ill.), and immobilized in the wells of streptavidin-coated 96 well plates (Pierce Chemical). In certain embodiments, the surfaces with immobilized assay components can be prepared in advance and stored.

Other suitable carriers or solid phase supports for such assays include any material capable of binding the class of molecule to which the marker or probe belongs. Well-known supports or carriers include, but are not limited to, glass, polystyrene, nylon, polypropylene, nylon, polyethylene, dextran, amylases, natural and modified celluloses, polyacrylamides, gabbros, and magnetite.

In order to conduct assays with the above mentioned approaches, the non-immobilized component is added to the solid phase upon which the second component is anchored. After the reaction is complete, uncomplexed components may be removed (e.g., by washing) under conditions such that any complexes formed will remain immobilized upon the solid phase. The detection of marker/probe complexes anchored to the solid phase can be accomplished in a number of methods outlined herein.

In a preferred embodiment, the probe, when it is the unanchored assay component, can be labeled for the purpose of detection and readout of the assay, either directly or indirectly, with detectable labels discussed herein and which are well-known to one skilled in the art.

It is also possible to directly detect marker/probe complex formation without further manipulation or labeling of either component (marker or probe), for example by utilizing the technique of fluorescence energy transfer (see, for example, Lakowicz et al., U.S. Pat. No. 5,631,169; Stavrianopoulos, et al., U.S. Pat. No. 4,868,103). A fluorophore label on the first, 'donor' molecule is selected such that, upon excitation with incident light of appropriate wavelength, its emitted fluorescent energy will be absorbed by a fluorescent label on a second 'acceptor' molecule, which in turn is able to fluoresce due to the absorbed energy. Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, spatial relationships between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter).

In another embodiment, determination of the ability of a probe to recognize a marker can be accomplished without labeling either assay component (probe or marker) by utilizing a technology such as real-time Biomolecular Interaction Analysis (BIA) (see, e.g., Sjolander, S, and Urbaniczky, C., 1991, *Anal. Chem.* 63:2338-2345 and Szabo et al., 1995, *Curr. Opin. Struct. Biol.* 5:699-705). As used herein, "BIA" or "surface plasmon resonance" is a technology for studying biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

Alternatively, in another embodiment, analogous diagnostic and prognostic assays can be conducted with marker and probe as solutes in a liquid phase. In such an assay, the complexed marker and probe are separated from uncomplexed components by any of a number of standard techniques, including but not limited to: differential centrifugation, chromatography, electrophoresis and immunoprecipitation. In differential centrifugation, marker/probe complexes may be separated from uncomplexed assay components through a series of centrifugal steps, due to the different sedimentation equilibria of complexes based on their different sizes and densities (see, for example, Rivas, G., and Minton, A. P., 1993, *Trends Biochem Sci.* 18(8):284-7). Standard chromatographic techniques may also be utilized to separate complexed molecules from uncomplexed ones. For example, gel filtration chromatography separates molecules based on size, and through the utilization of an appropriate gel filtration resin in a column format, for example, the relatively larger complex may be separated from the relatively smaller uncomplexed components. Similarly, the relatively different charge properties of the marker/probe complex as compared to the uncomplexed components may be exploited to differentiate the complex from uncomplexed components, for example through the utilization of ion-exchange chromatography resins. Such resins and chromatographic techniques are well known to one skilled in the art (see, e.g., Heegaard, N. H., 1998, *J. Mol. Recognit.* Winter 11(1-6):141-8; Hage, D. S., and Tweed, S. A. *J Chromatogr B Biomed Sci Appl* 1997 Oct. 10; 699(1-2):499-525). Gel electrophoresis may also be employed to separate complexed assay components from unbound components (see, e.g., Ausubel et al., ed., *Current Protocols in Molecular Biology*, John Wiley & Sons, New York, 1987-1999). In this technique, protein or nucleic acid complexes are separated based on size or charge, for example. In order to maintain the binding interaction during the electrophoretic process, non-denaturing gel matrix materials and conditions in the absence of reducing agent are typically preferred. Appropriate conditions to the particular assay and components thereof will be well known to one skilled in the art.

In a particular embodiment, the level of marker mRNA can be determined both by in situ and by in vitro formats in a biological sample using methods known in the art. The term "biological sample" is intended to include tissues, cells, biological fluids and isolates thereof, isolated from a subject, as well as tissues, cells and fluids present within a subject. Many expression detection methods use isolated RNA. For in vitro methods, any RNA isolation technique that does not select against the isolation of mRNA can be utilized for the purification of RNA from cells (see, e.g., Ausubel et al., ed., *Current Protocols in Molecular Biology*, John Wiley & Sons, New York 1987-1999). Additionally, large numbers of tissue samples can readily be processed using techniques well known to those of skill in the art, such as, for example, the single-step RNA isolation process of Chomczynski (1989, U.S. Pat. No. 4,843,155).

The isolated mRNA can be used in hybridization or amplification assays that include, but are not limited to, Southern or Northern analyses, polymerase chain reaction analyses and probe arrays. One preferred diagnostic method for the detection of mRNA levels involves contacting the isolated mRNA with a nucleic acid molecule (probe) that can hybridize to the mRNA encoded by the gene being detected. The nucleic acid probe can be, for example, a full-length cDNA, or a portion thereof, such as an oligonucleotide of at least 7, 15, 30, 50, 100, 250 or 500 nucleotides in length and sufficient to specifically hybridize under stringent conditions to a mRNA or genomic DNA encoding a marker of the present invention. Other suitable probes for use in the diagnostic assays of the invention are described herein. Hybridization of an mRNA with the probe indicates that the marker in question is being expressed.

In one format, the mRNA is immobilized on a solid surface and contacted with a probe, for example by running the isolated mRNA on an agarose gel and transferring the mRNA from the gel to a membrane, such as nitrocellulose. In an alternative format, the probe(s) are immobilized on a solid surface and the mRNA is contacted with the probe(s), for example, in an Affymetrix gene chip array. A skilled artisan can readily adapt known mRNA detection methods for use in detecting the level of mRNA encoded by the markers of the present invention.

An alternative method for determining the level of mRNA marker in a sample involves the process of nucleic acid amplification, e.g., by RT-PCR (the experimental embodiment set forth in Mullis, 1987, U.S. Pat. No. 4,683,202), ligase chain reaction (Barany, 1991, *Proc. Natl. Acad. Sci. USA*, 88:189-193), self sustained sequence replication (Guatelli et al., 1990, *Proc. Natl. Acad. Sci. USA* 87:1874-1878), transcriptional amplification system (Kwoh et al., 1989, *Proc. Natl. Acad. Sci. USA* 86:1173-1177), Q-Beta Replicase (Lizardi et al., 1988, *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. As used herein, amplification primers are defined as being a pair of nucleic acid molecules that can anneal to 5' or 3' regions of a gene (plus and minus strands, respectively, or vice-versa) and contain a short region in between. In general, amplification primers are from about 10 to 30 nucleotides in length and flank a region from about 50 to 200 nucleotides in length. Under appropriate conditions and with appropriate reagents, such primers permit the amplification of a nucleic acid molecule comprising the nucleotide sequence flanked by the primers.

For in situ methods, mRNA does not need to be isolated from the prior to detection. In such methods, a cell or tissue sample is prepared/processed using known histological methods. The sample is then immobilized on a support, typically a glass slide, and then contacted with a probe that can hybridize to mRNA that encodes the marker.

As an alternative to making determinations based on the absolute expression level of the marker, determinations may be based on the normalized expression level of the marker. Expression levels are normalized by correcting the absolute expression level of a marker by comparing its expression to the expression of a gene that is not a marker, e.g., a housekeeping gene that is constitutively expressed. Suitable genes for normalization include housekeeping genes such as the actin gene, or epithelial cell-specific genes. This normalization allows the comparison of the expression level in one sample, e.g., a patient sample, to another sample, e.g., a non-disease or non-toxic sample, or between samples from different sources.

Alternatively, the expression level can be provided as a relative expression level. To determine a relative expression level of a marker, the level of expression of the marker is determined for 10 or more samples of normal versus disease or toxic cell isolates, preferably 50 or more samples, prior to the determination of the expression level for the sample in question. The mean expression level of each of the genes assayed in the larger number of samples is determined and this is used as a baseline expression level for the marker. The expression level of the marker determined for the test sample (absolute level of expression) is then divided by the mean expression value obtained for that marker. This provides a relative expression level.

Preferably, the samples used in the baseline determination will be from non-disease or non-toxic cells. The choice of the cell source is dependent on the use of the relative expression level. Using expression found in normal tissues as a mean expression score aids in validating whether the marker assayed is disease or toxicity specific (versus normal cells). In addition, as more data is accumulated, the mean expression value can be revised, providing improved relative expression values based on accumulated data. Expression data from disease cells or toxic cells provides a means for grading the severity of the disease or toxic state.

In another embodiment of the present invention, a marker protein is detected. A preferred agent for detecting marker protein of the invention is an antibody capable of binding to such a protein or a fragment thereof, preferably an antibody with a detectable label. Antibodies can be polyclonal, or more preferably, monoclonal. An intact antibody, or a fragment or derivative thereof (e.g., Fab or F(ab')$^2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

Proteins from cells can be isolated using techniques that are well known to those of skill in the art. The protein isolation methods employed can, for example, be such as those described in Harlow and Lane (Harlow and Lane, 1988, Antibodies: A Laboratory Manual, Cold Spring Harbor Laboratory Press, Cold Spring Harbor, N.Y.).

A variety of formats can be employed to determine whether a sample contains a protein that binds to a given antibody. Examples of such formats include, but are not limited to, enzyme immunoassay (EIA), radioimmunoassay (RIA), Western blot analysis and enzyme linked immunoabsorbant assay (ELISA). A skilled artisan can readily adapt known protein/antibody detection methods for use in determining whether cells express a marker of the present invention.

In one format, antibodies, or antibody fragments or derivatives, can be used in methods such as Western blots or immunofluorescence techniques to detect the expressed proteins. In such uses, it is generally preferable to immobilize either the antibody or proteins on a solid support. Suitable solid phase supports or carriers include any support capable of binding an antigen or an antibody. Well-known supports or carriers include glass, polystyrene, polypropylene, polyethylene, dextran, nylon, amylases, natural and modified celluloses, polyacrylamides, gabbros, and magnetite.

One skilled in the art will know many other suitable carriers for binding antibody or antigen, and will be able to adapt such support for use with the present invention. For example, protein isolated from disease or toxic cells can be run on a polyacrylamide gel electrophoresis and immobilized onto a solid phase support such as nitrocellulose. The support can then be washed with suitable buffers followed by treatment with the detectably labeled antibody. The solid phase support can then be washed with the buffer a second time to remove unbound antibody. The amount of bound label on the solid support can then be detected by conventional means.

The invention also encompasses kits for detecting the presence of a marker protein or nucleic acid in a biological sample. Such kits can be used to determine if a subject is suffering from or is at increased risk of developing certain diseases or drug-induced toxicity. For example, the kit can comprise a labeled compound or agent capable of detecting a marker protein or nucleic acid in a biological sample and means for determining the amount of the protein or mRNA in the sample (e.g., an antibody which binds the protein or a fragment thereof, or an oligonucleotide probe which binds to DNA or mRNA encoding the protein). Kits can also include instructions for interpreting the results obtained using the kit.

For antibody-based kits, the kit can comprise, for example: (1) a first antibody (e.g., attached to a solid support) which binds to a marker protein; and, optionally, (2) a second, different antibody which binds to either the protein or the first antibody and is conjugated to a detectable label.

For oligonucleotide-based kits, the kit can comprise, for example: (1) an oligonucleotide, e.g., a detectably labeled oligonucleotide, which hybridizes to a nucleic acid sequence encoding a marker protein or (2) a pair of primers useful for amplifying a marker nucleic acid molecule. The kit can also comprise, e.g., a buffering agent, a preservative, or a protein stabilizing agent. The kit can further comprise components necessary for detecting the detectable label (e.g., an enzyme or a substrate). The kit can also contain a control sample or a series of control samples which can be assayed and compared to the test sample. Each component of the kit can be enclosed within an individual container and all of the various containers can be within a single package, along with instructions for interpreting the results of the assays performed using the kit.

G. Pharmacogenomics

The markers of the invention are also useful as pharmacogenomic markers. As used herein, a "pharmacogenomic marker" is an objective biochemical marker whose expression level correlates with a specific clinical drug response or susceptibility in a patient (see, e.g., McLeod et al. (1999) *Eur. J. Cancer* 35(12): 1650-1652). The presence or quantity of the pharmacogenomic marker expression is related to the predicted response of the patient and more particularly the patient's diseased or toxic cells to therapy with a specific drug or class of drugs. By assessing the presence or quantity of the expression of one or more pharmacogenomic markers in a patient, a drug therapy which is most appropriate for the patient, or which is predicted to have a greater degree of success, may be selected. For example, based on the presence or quantity of RNA or protein encoded by specific tumor markers in a patient, a drug or course of treatment may be selected that is optimized for the treatment of the specific tumor likely to be present in the patient. The use of pharmacogenomic markers therefore permits selecting or designing the most appropriate treatment for each cancer patient without trying different drugs or regimes.

Another aspect of pharmacogenomics deals with genetic conditions that alters the way the body acts on drugs. These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome P450 enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, a PM will show no therapeutic response, as demonstrated for the analgesic effect of codeine mediated by its CYP2D6-formed metabolite morphine. The other extreme are the so called ultra-rapid metabolizers who do not respond to standard doses. Recently, the molecular basis of ultra-rapid metabolism has been identified to be due to CYP2D6 gene amplification.

Thus, the level of expression of a marker of the invention in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with a modulator of expression of a marker of the invention.

H. Monitoring Clinical Trials

Monitoring the influence of agents (e.g., drug compounds) on the level of expression of a marker of the invention can be applied not only in basic drug screening, but also in clinical trials. For example, the effectiveness of an agent to affect marker expression can be monitored in clinical trials of subjects receiving treatment for certain diseases, such as cancer, diabetes, obesity, cardiovascular disease, and cardiotoxicity, or drug-induced toxicity. In a preferred embodiment, the present invention provides a method for monitoring the effectiveness of treatment of a subject with an agent (e.g., an agonist, antagonist, peptidomimetic, protein, peptide, nucleic acid, small molecule, or other drug candidate) comprising the steps of (i) obtaining a pre-administration sample from a subject prior to administration of the agent; (ii) detecting the level of expression of one or more selected markers of the invention in the pre-administration sample; (iii) obtaining one or more post-administration samples from the subject; (iv) detecting the level of expression of the marker(s) in the post-administration samples; (v) comparing the level of expression of the marker(s) in the pre-administration sample with the level of expression of the marker(s) in the post-administration sample or samples; and (vi) altering the administration of the agent to the subject accordingly. For example, increased expression of the marker gene(s) during the course of treatment may indicate ineffective dosage and the desirability of increasing the dosage. Conversely, decreased expression of the marker gene(s) may indicate efficacious treatment and no need to change dosage.

H. Arrays

The invention also includes an array comprising a marker of the present invention. The array can be used to assay expression of one or more genes in the array. In one embodiment, the array can be used to assay gene expression in a tissue to ascertain tissue specificity of genes in the array. In this manner, up to about 7600 genes can be simultaneously assayed for expression. This allows a profile to be developed showing a battery of genes specifically expressed in one or more tissues.

In addition to such qualitative determination, the invention allows the quantitation of gene expression. Thus, not only tissue specificity, but also the level of expression of a battery of genes in the tissue is ascertainable. Thus, genes can be grouped on the basis of their tissue expression per se and level of expression in that tissue. This is useful, for example, in ascertaining the relationship of gene expression between or among tissues. Thus, one tissue can be perturbed and the effect on gene expression in a second tissue can be determined. In this context, the effect of one cell type on another cell type in response to a biological stimulus can be determined. Such a determination is useful, for example, to know the effect of cell-cell interaction at the level of gene expression. If an agent is administered therapeutically to treat one cell type but has an undesirable effect on another cell type, the invention provides an assay to determine the molecular basis of the undesirable effect and thus provides the opportunity to co-administer a counteracting agent or otherwise treat the undesired effect. Similarly, even within a single cell type, undesirable biological effects can be determined at the molecular level. Thus, the effects of an agent on expression of other than the target gene can be ascertained and counteracted.

In another embodiment, the array can be used to monitor the time course of expression of one or more genes in the array. This can occur in various biological contexts, as disclosed herein, for example development of drug-induced toxicity, progression of drug-induced toxicity, and processes, such a cellular transformation associated with drug-induced toxicity.

The array is also useful for ascertaining the effect of the expression of a gene on the expression of other genes in the same cell or in different cells. This provides, for example, for a selection of alternate molecular targets for therapeutic intervention if the ultimate or downstream target cannot be regulated.

The array is also useful for ascertaining differential expression patterns of one or more genes in normal and abnormal cells. This provides a battery of genes that could serve as a molecular target for diagnosis or therapeutic intervention.

VII. Methods for Obtaining Samples

Samples useful in the methods of the invention include any tissue, cell, biopsy, or bodily fluid sample that expresses a marker of the invention. In one embodiment, a sample may be a tissue, a cell, whole blood, serum, plasma, buccal scrape, saliva, cerebrospinal fluid, urine, stool, or bronchoalveolar lavage. In preferred embodiments, the tissue sample is a disease state or toxicity state sample. In more preferred embodiments, the tissue sample is a cancer sample, a diabetes sample, an obesity sample, a cardiovascular sample or a drug-induced toxicity sample.

Body samples may be obtained from a subject by a variety of techniques known in the art including, for example, by the use of a biopsy or by scraping or swabbing an area or by using a needle to aspirate bodily fluids. Methods for collecting various body samples are well known in the art.

Tissue samples suitable for detecting and quantitating a marker of the invention may be fresh, frozen, or fixed according to methods known to one of skill in the art. Suitable tissue samples are preferably sectioned and placed on a microscope slide for further analyses. Alternatively, solid samples, i.e., tissue samples, may be solubilized and/or homogenized and subsequently analyzed as soluble extracts.

In one embodiment, a freshly obtained biopsy sample is frozen using, for example, liquid nitrogen or difluorodichloromethane. The frozen sample is mounted for sectioning using, for example, OCT, and serially sectioned in a cryostat. The serial sections are collected on a glass microscope slide. For immunohistochemical staining the slides may be coated with, for example, chrome-alum, gelatine or poly-L-lysine to ensure that the sections stick to the slides. In another embodiment, samples are fixed and embedded prior to sectioning. For example, a tissue sample may be fixed in, for example, formalin, serially dehydrated and embedded in, for example, paraffin.

Once the sample is obtained any method known in the art to be suitable for detecting and quantitating a marker of the invention may be used (either at the nucleic acid or at the protein level). Such methods are well known in the art and include but are not limited to western blots, northern blots, southern blots, immunohistochemistry, ELISA, e.g., amplified ELISA, immunoprecipitation, immunofluorescence, flow cytometry, immunocytochemistry, mass spectrometric analyses, e.g., MALDI-TOF and SELDI-TOF, nucleic acid hybridization techniques, nucleic acid reverse transcription methods, and nucleic acid amplification methods. In particular embodiments, the expression of a marker of the invention is detected on a protein level using, for example, antibodies that specifically bind these proteins.

Samples may need to be modified in order to make a marker of the invention accessible to antibody binding. In a particular aspect of the immunocytochemistry or immunohistochemistry methods, slides may be transferred to a pretreatment buffer and optionally heated to increase antigen accessibility. Heating of the sample in the pretreatment buffer rapidly disrupts the lipid bi-layer of the cells and makes the antigens (may be the case in fresh specimens, but not typically what occurs in fixed specimens) more accessible for antibody binding. The terms "pretreatment buffer" and "preparation buffer" are used interchangeably herein to refer to a buffer that is used to prepare cytology or histology samples for immunostaining, particularly by increasing the accessibility of a marker of the invention for antibody binding. The pretreatment buffer may comprise a pH-specific salt solution, a polymer, a detergent, or a nonionic or anionic surfactant such as, for example, an ethyloxylated anionic or nonionic surfactant, an alkanoate or an alkoxylate or even blends of these surfactants or even the use of a bile salt. The pretreatment buffer may, for example, be a solution of 0.1% to 1% of deoxycholic acid, sodium salt, or a solution of sodium laureth-13-carboxylate (e.g., Sandopan LS) or and ethoxylated anionic complex. In some embodiments, the pretreatment buffer may also be used as a slide storage buffer.

Any method for making marker proteins of the invention more accessible for antibody binding may be used in the practice of the invention, including the antigen retrieval methods known in the art. See, for example, Bibbo, et al. (2002) *Acta. Cytol.* 46:25-29; Saqi, et al. (2003) *Diagn. Cytopathol.* 27:365-370; Bibbo, et al. (2003) *Anal. Quant. Cytol. Histol.* 25:8-11, the entire contents of each of which are incorporated herein by reference.

Following pretreatment to increase marker protein accessibility, samples may be blocked using an appropriate blocking agent, e.g., a peroxidase blocking reagent such as hydrogen peroxide. In some embodiments, the samples may be blocked using a protein blocking reagent to prevent non-specific binding of the antibody. The protein blocking reagent may comprise, for example, purified casein. An antibody, particularly a monoclonal or polyclonal antibody that specifically binds to a marker of the invention is then incubated with the sample. One of skill in the art will appreciate that a more accurate prognosis or diagnosis may be obtained in some cases by detecting multiple epitopes on a marker protein of the invention in a patient sample. Therefore, in particular embodiments, at least two antibodies directed to different epitopes of a marker of the invention are used. Where more than one antibody is used, these antibodies may be added to a single sample sequentially as individual antibody reagents or simultaneously as an antibody cocktail. Alternatively, each individual antibody may be added to a separate sample from the same patient, and the resulting data pooled.

Techniques for detecting antibody binding are well known in the art. Antibody binding to a marker of the invention may be detected through the use of chemical reagents that generate a detectable signal that corresponds to the level of antibody binding and, accordingly, to the level of marker protein expression. In one of the immunohistochemistry or immunocytochemistry methods of the invention, antibody binding is detected through the use of a secondary antibody that is conjugated to a labeled polymer. Examples of labeled polymers include but are not limited to polymer-enzyme conjugates. The enzymes in these complexes are typically used to catalyze the deposition of a chromogen at the antigen-antibody binding site, thereby resulting in cell staining that corresponds to expression level of the biomarker of interest. Enzymes of particular interest include, but are not limited to, horseradish peroxidase (HRP) and alkaline phosphatase (AP).

In one particular immunohistochemistry or immunocytochemistry method of the invention, antibody binding to a marker of the invention is detected through the use of an HRP-labeled polymer that is conjugated to a secondary antibody. Antibody binding can also be detected through the use of a species-specific probe reagent, which binds to monoclonal or polyclonal antibodies, and a polymer conjugated to HRP, which binds to the species specific probe reagent. Slides are stained for antibody binding using any chromagen, e.g., the chromagen 3,3-diaminobenzidine (DAB), and then counterstained with hematoxylin and, optionally, a bluing agent such as ammonium hydroxide or TBS/Tween-20. Other suitable chromagens include, for example, 3-amino-9-ethylcarbazole (AEC). In some aspects of the invention, slides are reviewed microscopically by a cytotechnologist and/or a pathologist to assess cell staining, e.g., fluorescent staining (i.e., marker expression). Alternatively, samples may be reviewed via automated microscopy or by personnel with the assistance of computer software that facilitates the identification of positive staining cells.

Detection of antibody binding can be facilitated by coupling the anti-marker antibodies to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin; and examples of suitable radioactive material include $^{125}$I, $^{131}$I, $^{35}$S, $^{14}$C, or $^{3}$H.

In one embodiment of the invention frozen samples are prepared as described above and subsequently stained with antibodies against a marker of the invention diluted to an appropriate concentration using, for example, Tris-buffered saline (TBS). Primary antibodies can be detected by incubating the slides in biotinylated anti-immunoglobulin. This signal can optionally be amplified and visualized using diaminobenzidine precipitation of the antigen. Furthermore, slides can be optionally counterstained with, for example, hematoxylin, to visualize the cells.

In another embodiment, fixed and embedded samples are stained with antibodies against a marker of the invention and counterstained as described above for frozen sections. In addition, samples may be optionally treated with agents to amplify the signal in order to visualize antibody staining. For example, a peroxidase-catalyzed deposition of biotinyl-tyramide, which in turn is reacted with peroxidase-conjugated streptavidin (Catalyzed Signal Amplification (CSA) System, DAKO, Carpinteria, Calif.) may be used.

Tissue-based assays (i.e., immunohistochemistry) are the preferred methods of detecting and quantitating a marker of the invention. In one embodiment, the presence or absence of a marker of the invention may be determined by immunohistochemistry. In one embodiment, the immunohistochemical analysis uses low concentrations of an anti-marker antibody such that cells lacking the marker do not stain. In another embodiment, the presence or absence of a marker of the invention is determined using an immunohistochemical method that uses high concentrations of an anti-marker antibody such that cells lacking the marker protein stain heavily. Cells that do not stain contain either mutated marker and fail to produce antigenically recognizable marker protein, or are cells in which the pathways that regulate marker levels are dysregulated, resulting in steady state expression of negligible marker protein.

One of skill in the art will recognize that the concentration of a particular antibody used to practice the methods of the invention will vary depending on such factors as time for binding, level of specificity of the antibody for a marker of the invention, and method of sample preparation. Moreover, when multiple antibodies are used, the required concentration may be affected by the order in which the antibodies are applied to the sample, e.g., simultaneously as a cocktail or sequentially as individual antibody reagents. Furthermore, the detection chemistry used to visualize antibody binding to a marker of the invention must also be optimized to produce the desired signal to noise ratio.

In one embodiment of the invention, proteomic methods, e.g., mass spectrometry, are used for detecting and quantitating the marker proteins of the invention. For example, matrix-associated laser desorption/ionization time-of-flight mass spectrometry (MALDI-TOF MS) or surface-enhanced laser desorption/ionization time-of-flight mass spectrometry (SELDI-TOF MS) which involves the application of a biological sample, such as serum, to a protein-binding chip (Wright, G. L., Jr., et al. (2002) *Expert Rev Mol Diagn* 2:549; Li, J., et al. (2002) *Clin Chem* 48:1296; Laronga, C., et al. (2003) *Dis Markers* 19:229; Petricoin, E. F., et al. (2002) 359:572; Adam, B. L., et al. (2002) *Cancer Res* 62:3609; Tolson, J., et al. (2004) *Lab Invest* 84:845; Xiao, Z., et al. (2001) *Cancer Res* 61:6029) can be used to detect and quantitate the PY-Shc and/or p66-Shc proteins. Mass spectrometric methods are described in, for example, U.S. Pat. Nos. 5,622,824, 5,605,798 and 5,547,835, the entire contents of each of which are incorporated herein by reference.

In other embodiments, the expression of a marker of the invention is detected at the nucleic acid level. Nucleic acid-based techniques for assessing expression are well known in the art and include, for example, determining the level of marker mRNA in a sample from a subject. Many expression detection methods use isolated RNA. Any RNA isolation technique that does not select against the isolation of mRNA can be utilized for the purification of RNA from cells that express a marker of the invention (see, e.g., Ausubel et al., ed., (1987-1999) Current Protocols in Molecular Biology (John Wiley & Sons, New York). Additionally, large numbers of tissue samples can readily be processed using techniques well known to those of skill in the art, such as, for example, the single-step RNA isolation process of Chomczynski (1989, U.S. Pat. No. 4,843,155).

The term "probe" refers to any molecule that is capable of selectively binding to a marker of the invention, for example, a nucleotide transcript and/or protein. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or Northern analyses, polymerase chain reaction analyses and probe arrays. One method for the detection of mRNA levels involves contacting the isolated mRNA with a nucleic acid molecule (probe) that can hybridize to the marker mRNA. The nucleic acid probe can be, for example, a full-length cDNA, or a portion thereof, such as an oligonucleotide of at least 7, 15, 30, 50, 100, 250 or 500 nucleotides in length and sufficient to specifically hybridize under stringent conditions to marker genomic DNA.

In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in detecting the level of marker mRNA.

An alternative method for determining the level of marker mRNA in a sample involves the process of nucleic acid amplification, e.g., by RT-PCR (the experimental embodiment set forth in Mullis, 1987, U.S. Pat. No. 4,683,202), ligase chain reaction (Barany (1991) Proc. Natl. Acad. Sci. USA 88:189-193), self sustained sequence replication (Guatelli et al. (1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988) Bio/Technology 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, marker expression is assessed by quantitative fluorogenic RT-PCR (i.e., the TaqMan™ System). Such methods typically utilize pairs of oligonucleotide primers that are specific for a marker of the invention. Methods for designing oligonucleotide primers specific for a known sequence are well known in the art.

The expression levels of a marker of the invention may be monitored using a membrane blot (such as used in hybridization analysis such as Northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The detection of marker expression may also comprise using nucleic acid probes in solution.

In one embodiment of the invention, microarrays are used to detect the expression of a marker of the invention. Microarrays are particularly well suited for this purpose because of the reproducibility between different experiments. DNA microarrays provide one method for the simultaneous measurement of the expression levels of large numbers of genes. Each array consists of a reproducible pattern of capture probes attached to a solid support. Labeled RNA or DNA is hybridized to complementary probes on the array and then detected by laser scanning. Hybridization intensities for each probe on the array are determined and converted to a quantitative value representing relative gene expression levels. See, U.S. Pat. Nos. 6,040,138, 5,800,992 and 6,020,135, 6,033,860, and 6,344,316, which are incorporated herein by reference. High-density oligonucleotide arrays are particularly useful for determining the gene expression profile for a large number of RNA's in a sample.

The amounts of marker, and/or a mathematical relationship of the amounts of a marker of the invention may be used to calculate the risk of recurrence of a disease state, e.g. cancer, diabetes, obesity, cardiovascular disease, or a toxicity state, e.g., a drug-induced toxicity or cardiotoxicity, in a subject being treated for a disease state or toxicity state, the survival of a subject being treated for a disease state or a toxicity state, whether a disease state or toxicity state is aggressive, the efficacy of a treatment regimen for treating a disease state or toxicity state, and the like, using the methods of the invention, which may include methods of regression analysis known to one of skill in the art. For example, suitable regression models include, but are not limited to CART (e.g., Hill, T, and Lewicki, P. (2006) "STATISTICS Methods and Applications" StatSoft, Tulsa, Okla.), Cox (e.g., www dot evidence-based-medicine dot co dot uk), exponential, normal and log normal (e.g., www dot obgyn dot cam dot ac dot uk/mrg/statsbook/stsurvan dot html), logistic (e.g., www dot en dot Wikipedia dot org/wiki/Logistic_regression), parametric, non-parametric, semi-parametric (e.g., www dot socserv dot mcmaster dot ca/jfox/Books/Companion), linear (e.g., www dot en dot Wikipedia dot org/wiki/Linear_regression), or additive (e.g., www dot en dot Wikipedia dot org/wiki/Generalized_additive_model).

In one embodiment, a regression analysis includes the amounts of marker. In another embodiment, a regression analysis includes a marker mathematical relationship. In yet another embodiment, a regression analysis of the amounts of marker, and/or a marker mathematical relationship may include additional clinical and/or molecular co-variates. Such clinical co-variates include, but are not limited to, nodal status, tumor stage, tumor grade, tumor size, treatment regime, e.g., chemotherapy and/or radiation therapy, clinical outcome (e.g., relapse, disease-specific survival, therapy failure), and/or clinical outcome as a function of time after diagnosis, time after initiation of therapy, and/or time after completion of treatment.

VIII. Kits

The invention also provides compositions and kits for prognosing a disease state, e.g. cancer, diabetes, obesity, cardiovascular disease, or a toxicity state, e.g., a drug-induced toxicity or cardiotoxicity, recurrence of a disease state or a toxicity state, or survival of a subject being treated for a disease state or a toxicity state. These kits include one or more of the following: a detectable antibody that specifically binds to a marker of the invention, a detectable antibody that specifically binds to a marker of the invention, reagents for obtaining and/or preparing subject tissue samples for staining, and instructions for use.

The kits of the invention may optionally comprise additional components useful for performing the methods of the invention. By way of example, the kits may comprise fluids (e.g., SSC buffer) suitable for annealing complementary nucleic acids or for binding an antibody with a protein with which it specifically binds, one or more sample compartments, an instructional material which describes performance of a method of the invention and tissue specific controls/standards.

IX. Screening Assays

Targets of the invention include, but are not limited to, the genes and/or proteins listed herein. Based on the results of experiments described by Applicants herein, the key proteins modulated in a disease state or a toxicity state are associated with or can be classified into different pathways or groups of molecules, including cytoskeletal components, transcription factors, apoptotic response, pentose phosphate pathway, biosynthetic pathway, oxidative stress (pro-oxidant), membrane alterations, and oxidative phosphorylation metabolism.

Accordingly, in one embodiment of the invention, a marker may include one or more genes (or proteins) selected from the group consisting of HSPA8, FLNB, PARK7, HSPA1A/HSPA1B, ST13, TUBB3, MIF, KARS, NARS, LGALS1, DDX17, EIF5A, HSPA5, DHX9, HNRNPC, CKAP4, HSPA9, PARP1, HADHA, PHB2, ATP5A1, CANX, GRP78, GRP75, TIMP1, PTX3, HSP76, PDIA4, PDIA1, CA2D1, GPAT1 and TAZ. In one embodiment, a marker may include one or more genes (or proteins) selected from the group consisting of GRP78, GRP75, TIMP1, PTX3, HSP76, PDIA4, PDIA1, CA2D1, GPAT1 and TAZ. In some embodiments, the markers are a combination of at least two, three, four, five, six, seven, eight, nine, ten, eleven, twelve, thirteen, fourteen, fifteen, sixteen, seventeen, eighteen, nineteen, twenty, twenty-five, thirty, or more of the foregoing genes (or proteins).

Screening assays useful for identifying modulators of identified markers are described below.

The invention also provides methods (also referred to herein as "screening assays") for identifying modulators, i.e., candidate or test compounds or agents (e.g., proteins, peptides, peptidomimetics, peptoids, small molecules or other drugs), which are useful for treating or preventing a disease state or a toxicity state by modulating the expression and/or activity of a marker of the invention. Such assays typically comprise a reaction between a marker of the invention and one or more assay components. The other components may be either the test compound itself, or a combination of test compounds and a natural binding partner of a marker of the invention. Compounds identified via assays such as those described herein may be useful, for example, for modulating, e.g., inhibiting, ameliorating, treating, or preventing aggressiveness of a disease state or toxicity state.

The test compounds used in the screening assays of the present invention may be obtained from any available source, including systematic libraries of natural and/or synthetic compounds. Test compounds may also be obtained by any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive; see, e.g., Zuckermann et al., 1994, *J. Med. Chem.* 37:2678-85); spatially addressable parallel solid phase or solution phase libraries; synthetic library methods requiring deconvolution; the 'one-bead one-compound' library method; and synthetic library methods using affinity chromatography selection. The biological library and peptoid library approaches are limited to peptide libraries, while the other four approaches are applicable to peptide, non-peptide oligomer or small molecule libraries of compounds (Lam, 1997, *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and in Gallop et al. (1994) *J. Med. Chem.* 37:1233.

Libraries of compounds may be presented in solution (e.g., Houghten, 1992, *Biotechniques* 13:412-421), or on beads (Lam, 1991, *Nature* 354:82-84), chips (Fodor, 1993, *Nature* 364:555-556), bacteria and/or spores, (Ladner, U.S. Pat. No. 5,223,409), plasmids (Cull et al, 1992, *Proc Natl Acad Sci USA* 89:1865-1869) or on phage (Scott and Smith, 1990, *Science* 249:386-390; Devlin, 1990, *Science* 249:404-406; Cwirla et al, 1990, *Proc. Natl. Acad. Sci.* 87:6378-6382; Felici, 1991, *J. Mol. Biol.* 222:301-310; Ladner, supra.).

The screening methods of the invention comprise contacting a disease state cell or a toxicity state cell with a test compound and determining the ability of the test compound to modulate the expression and/or activity of a marker of the invention in the cell. The expression and/or activity of a marker of the invention can be determined as described herein.

In another embodiment, the invention provides assays for screening candidate or test compounds which are substrates of a marker of the invention or biologically active portions thereof. In yet another embodiment, the invention provides assays for screening candidate or test compounds which bind to a marker of the invention or biologically active portions thereof. Determining the ability of the test compound to directly bind to a marker can be accomplished, for example, by coupling the compound with a radioisotope or enzymatic label such that binding of the compound to the marker can be determined by detecting the labeled marker compound in a complex. For example, compounds (e.g., marker substrates) can be labeled with $^{131}$I, $^{125}$I, $^{35}$S, $^{14}$C, or $^{3}$H, either directly or indirectly, and the radioisotope detected by direct counting of radioemission or by scintillation counting. Alternatively, assay components can be enzymatically labeled with, for example, horseradish peroxidase, alkaline phosphatase, or luciferase, and the enzymatic label detected by determination of conversion of an appropriate substrate to product.

This invention further pertains to novel agents identified by the above-described screening assays. Accordingly, it is within the scope of this invention to further use an agent identified as described herein in an appropriate animal model. For example, an agent capable of modulating the expression and/or activity of a marker of the invention identified as described herein can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatment as described above.

EXEMPLIFICATION OF THE INVENTION

Example 1: Employing Platform Technology to Build a Cancer Consensus and Simulation Networks In this example, the platform technology described in detail above was employed to integrate data obtained from a custom built in vitro cancer model, and thereby identify novel proteins/pathways driving the pathogenesis of cancer. Relational maps resulting from this analysis have provided cancer treatment targets, as well as diagnostic/prognostic markers associated with cancer.

Figure 18:
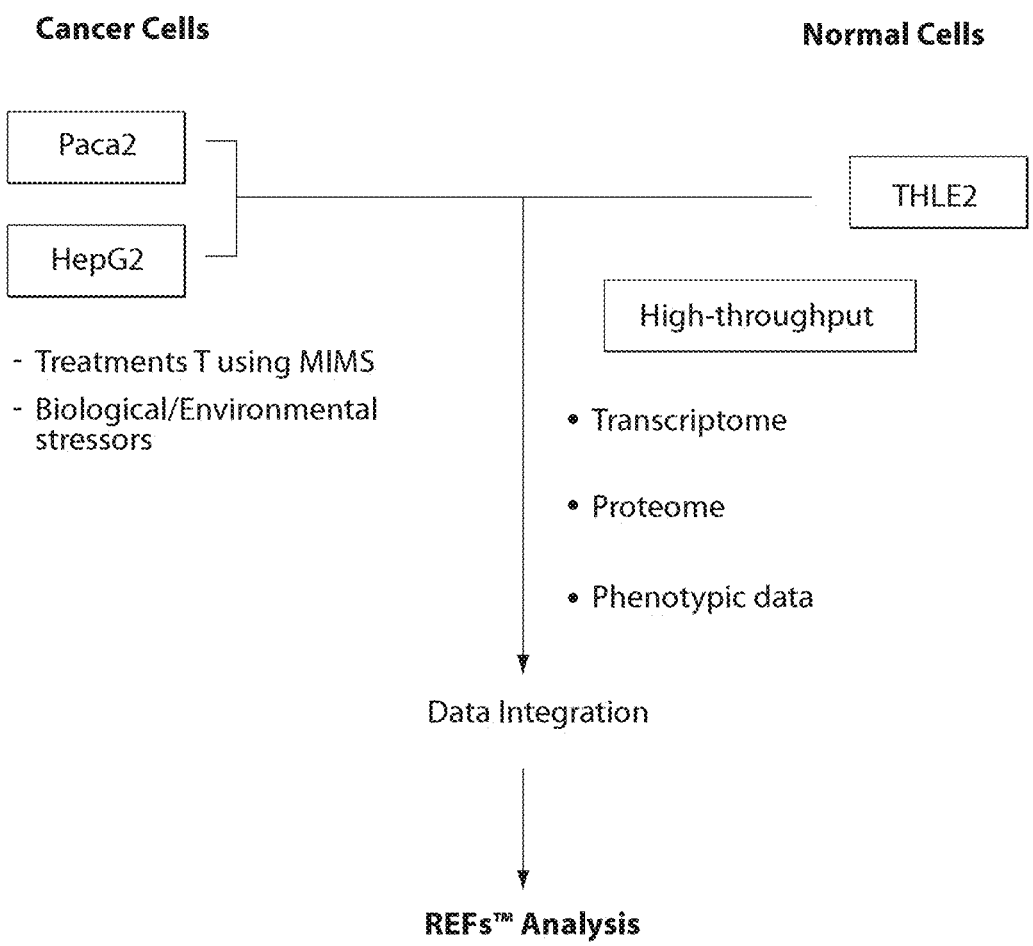
FIG. 18: Illustration of case study design described in Example 1.

The study design is depicted in FIG. 18. Briefly, two cancer cell lines (PaCa2, HepG2) and one normal cell line (THLE2) were subjected to one of seven conditions simulating an environment experienced by cancer cells in vivo. Specifically, cells were exposed to hyperglycemic condition, hypoxia condition, lactic acid condition, hyperglycemic+hypoxia combination condition, hyperglycemic+lactic acid combination condition, hypoxia+lactic acid combination condition, or hyperglycemic+hypoxia+lactic acid combination condition. Different conditions were created as the following:

Hyperglycemic condition was created by culturing the cells in media containing 22 mM glucose.

Hypoxia condition was induced by placing the cells in a Modular Incubator Chamber (MIC-101, Billups-Rothenberg Inc. Del Mar, Calif.), which was flooded with an industrial gas mix containing 5% $CO_2$, 2% $O_2$ and 93% nitrogen.

Lactic acid condition was created by culturing the cells in media containing 12.5 mM lactic acid.

Hyperglycemic+hypoxia combination condition was created by culturing the cells in media containing 22 mM glucose and the cells were placed in a Modular Incubator Chamber flooded with an industrial gas mix containing 5% $CO_2$, 2% $O_2$ and 93% nitrogen.

Hyperglycemic+lactic acid combination condition was created by culturing the cells in media containing 22 mM glucose and 12.5 mM lactic acid.

Hypoxia+lactic acid combination condition was created by culturing the cells in media containing 12.5 mM lactic acid and the cells were placed in a Modular Incubator Chamber flooded with an industrial gas mix containing 5% $CO_2$, 2% $O_2$ and 93% nitrogen.

Hyperglycemic+hypoxia+lactic acid combination condition was created by culturing the cells in media containing 22 mM glucose and 12.5 mM lactic acid, and the cells were placed in a Modular Incubator Chamber flooded with an industrial gas mix containing 5% $CO_2$, 2% $O_2$ and 93% nitrogen.

The cell model comprising the above-mentioned cells, wherein the cells were exposed to each condition described above, was additionally interrogated by exposing the cells to an environmental perturbation by treating with Coenzyme Q10. Specifically, the cells were treated with Coenzyme Q10 at 0, 50 μM, or 100 μM.

Cell samples as well as media samples for each cell line with each condition and each Coenzyme Q10 treatment were collected at various times following treatment, including after 24 hours and 48 hours of treatment.

In addition, cross talk experiments between two different cancer cells, PaCa2 and HepG2 cells, were carried out in which PaCa2 and HepG2 cells were co-cultured. This co-culturing approach is referred to as an extracellular secretome (ECS) experiment. The first cell system (PaCa2) was first seeded in the inserts of the wells of a transwell type growth chamber. Six well plates were used to enable better statistical analysis. At the time of seeding with the first cell system in the inserts, the inserts were placed in a separate 6-well plate. The second cell system (HepG2) was seeded on the primary tray. The insert tray containing the first cell system and the primary tray containing the second cell system were incubated at 37° C. overnight. Each of the cell systems was grown in the specific cell specific media (wherein alternatively, each of the cell systems could be grown in a medium adapted to support the growth of both cell types). On the second day, the pre-determined treatment was given by media exchange. Specifically, the inserts containing the first cell system were placed into the primary tray containing the second cell system. The tray was then incubated for a pre-determined time period, e.g., 24 hour or 48 hours. Duplicate wells were set up with the same conditions, and cells were pooled to yield sufficient material for 2D analysis. The media (1 ml aliquot), the cells from the inserts and the cells from the wells of the primary tray were harvested as separate samples. The experiments were conducted in triplicate in order to provide better statistical analysis power.

Cross-talk experiments were also conducted by "media swap" experiments. Specifically, a cultured media or "secretome" from the first cell system (PaCa2) was collected after 24 hrs or 48 hrs following perturbation or conditioning as described above and then added to the second cell system (HepG2) for 24-48 hrs. The final cultured media or "secretome" from the second cell system was then collected. All final secretomes were subjected to proteomic analysis.

iProfiling of changes in total cellular protein expression by quantitative proteomics was performed for cell and media samples collected for each cell line at each condition and with each "environmental perturbation", i.e, Coenzyme Q10 treatment, using the techniques described above in the detailed description. iProfiling of changes in total cellular protein expression by quantitative proteomics was similarly performed for cell and media samples collected for each co-cultured cell line at each condition with each treatment.

Further, bioenergetics profiling of the cancer, normal cells and cells in cross-talk experiments exposed to each condition and with or without Coenzyme Q10 perturbation were generated by employing the Seahorse analyzer essentially as recommended by the manufacturer. OCR (Oxygen consumption rate) and ECAR (Extracullular Acidification Rate) were recorded by the electrodes in a 7 μl chamber created with the cartridge pushing against the seahorse culture plate.

Proteomics data collected for each cell line (including cells in cross-talk experiments) at each condition and with each perturbation, and bioenergetics profiling data collected for each cell line at each condition and with each perturbation, were all inputted and processed by the REFS™ system. Raw data for Paca2, HepG2, THLE2 and cross-talk experiments were then combined using a standardized nomencalture. Genes with more than 15% of the proteomics data missing were filtered out. Data imputation strategy was developed. For example, a within replicates error model was used to impute data from experimental conditions with replicates. A K-NN algorithm based on 10 neighbors was used to impute data with no replicates. Different REFS™ models were built for three biological systems together, for just the Paca2 system, or for just the HepG2 system linked to the phenotypic data.

The area under the curve and fold changes for each edge connecting a parent node to a child node in the simulation networks were extracted by a custom-built program using the R programming language, where the R programming language is an open source software environment for statistical computing and graphics.

Output from the R program were inputted into Cytoscape, an open source program, to generate a visual representation of the consensus network.

Figures 1, 21:
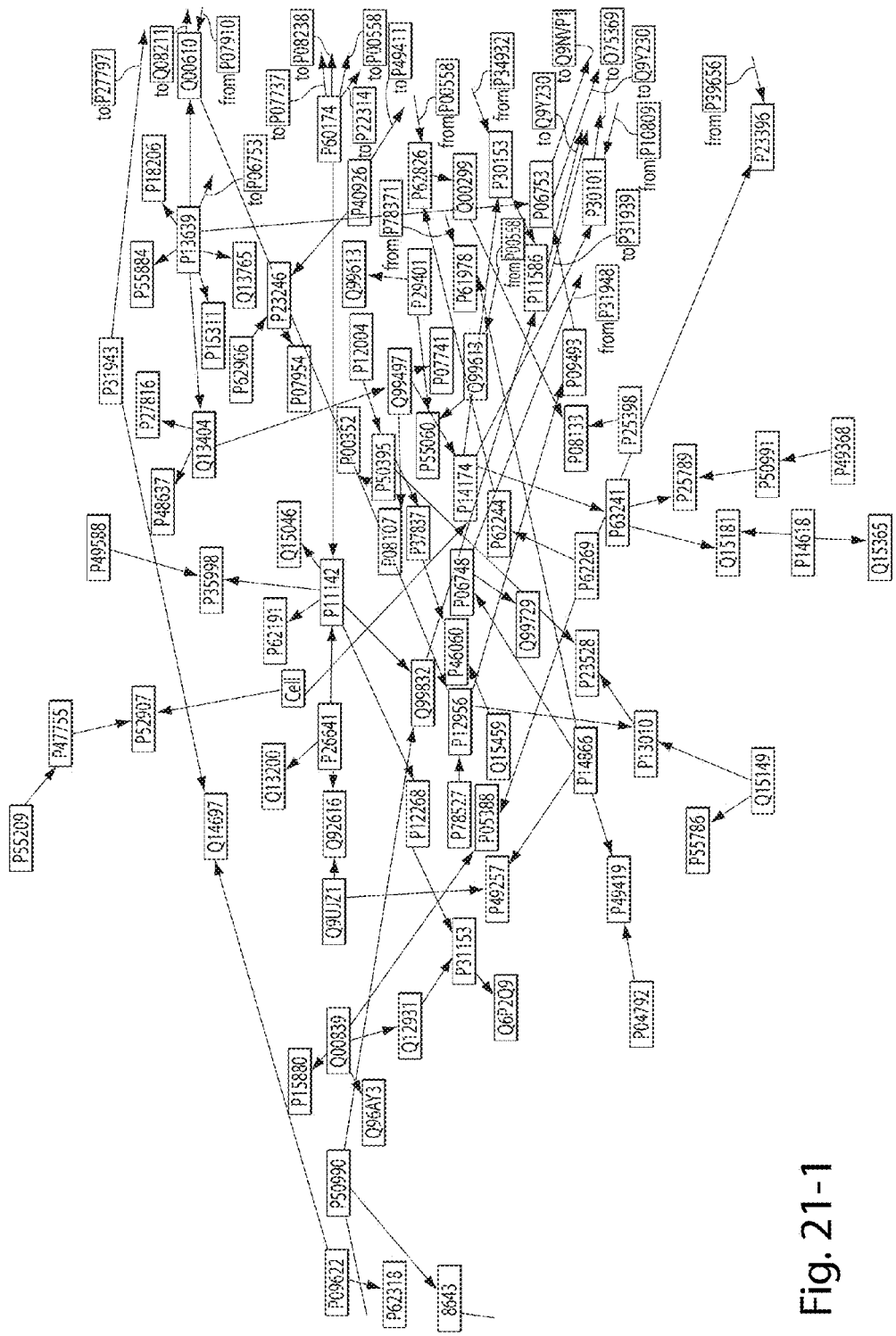
FIG. 21: Exemplary protein interaction consensus network at 70% fragment frequency based on data from Paca2, HepG2 and THLE2 cell lines.
Figures 2, 21:
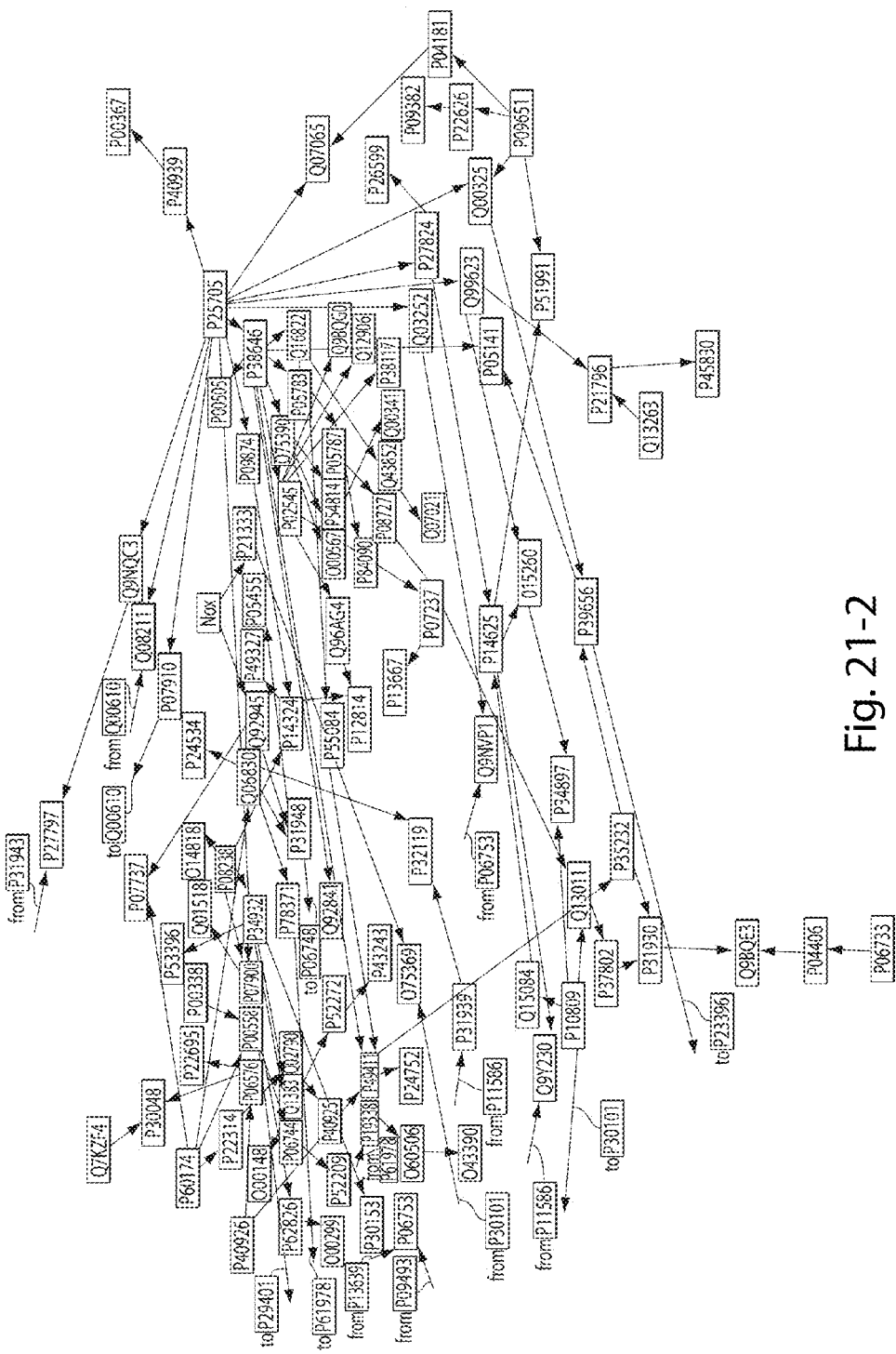

Among all the models built, an exemplary protein interaction REFS consensus network at 70% fragment frequency is shown in FIG. 21.

Each node in the consensus network shown in FIG. 21 was simulated by increasing or decreasing expression of LDHA by 4-fold to generate a simulation network using REFS™, as described in detail above in the detailed description.

Figure 22:
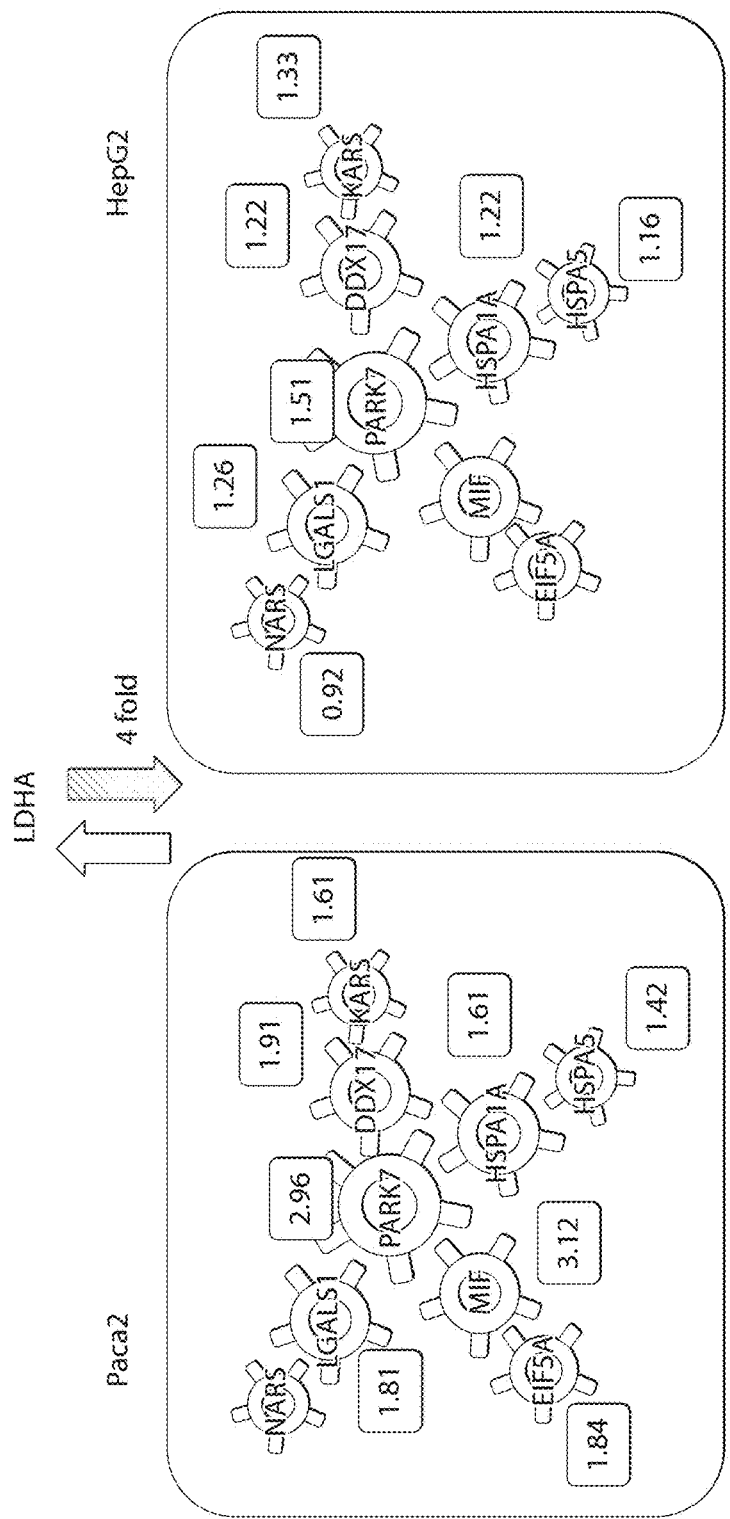
FIG. 22: Proteins responsive to LDHA expression simulation in two cancer cell lines were identified using the platform technology.

The effect of simulated LDHA expression change on PARK7 and proteins in notes associated with PARK7 at high level in the exemplary consensus network shown in FIG. 21 were investigated. Proteins responsive to the LDHA simulation in two cancer cell lines, i.e., Paca2 and HepG2, were identified using REFS™ (see FIG. 22). The numbers represent particular protein expression level fold changes.

To validate the protein connections identified using the above method, markers identified to be in immediate proximity to LDHA in the simulation network were inputted to IPA, a software program that utilizes neural networks to determine molecular linkage between experimental outputs to networks based on previously published literature. Output of the IPA program is shown in FIG. 23, wherein the markers in grey shapes were identified to be in immediate proximity to LDHA in the simulation network generated by the platform and the markers in unfilled shapes are connections identified by IPA based on known knowledge in previously published literature.

Figure 23:
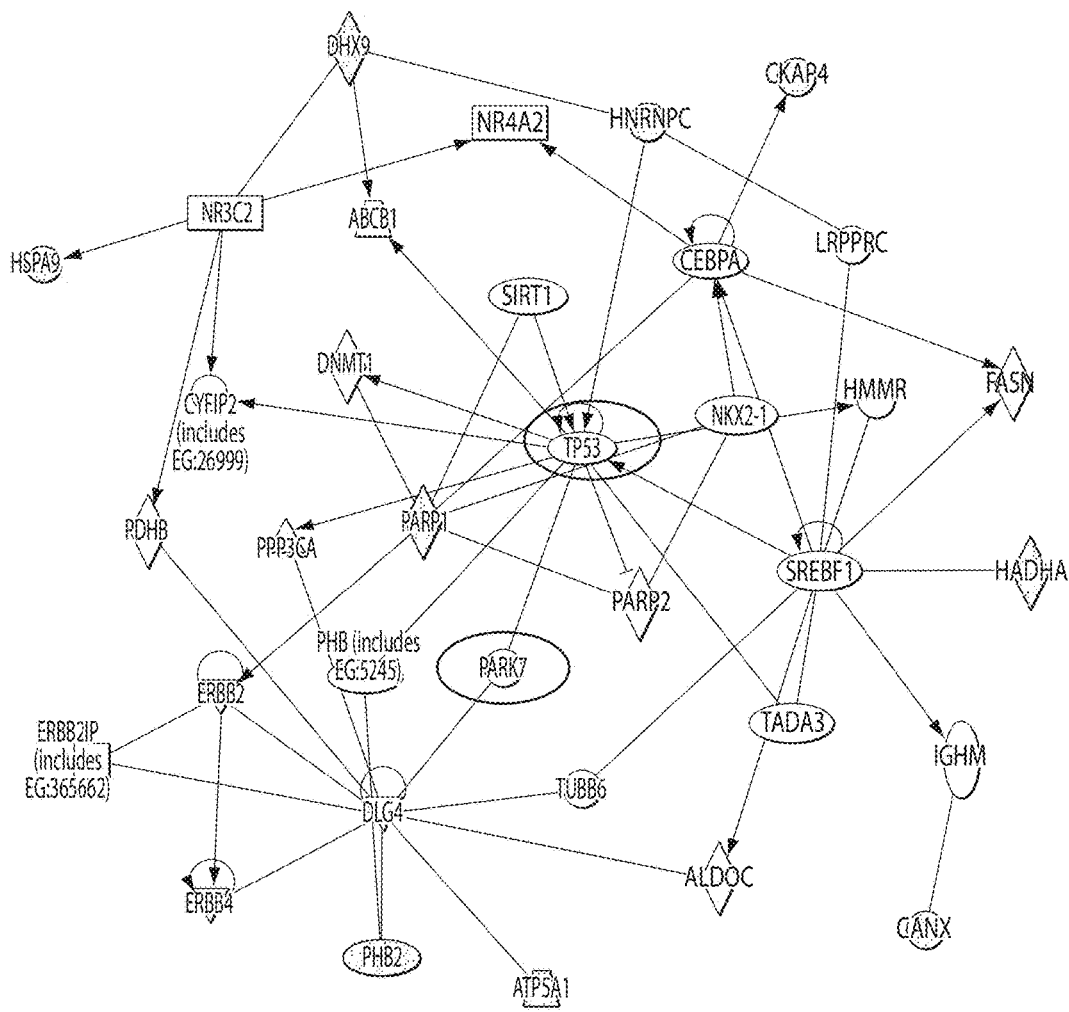
FIG. 23: Ingenuity Pathway Assist® analysis of LDHA—PARK7 network identifies TP53 as upstream hub.

Markers identified in the output from the Interrogative Biology platform technology (shown in FIG. 21), i.e. DHX9, HNRNPC, CKAP4, HSPA9, PARP1, HADHA, PHB2, ATP5A1 and CANX were observed to be connected to well-known cancer markers such as TP53 and PARK7 within the IPA generated network (shown in FIG. 23). The fact that the factors identified by the use of the Interrogative Biology platform share connectivity with known factors published in the scientific literatures validated the accuracy of the network created by the use of the Interrogative Biology Platform. In addition, the network association within the LDHA sub-network created by the use of the Interrogative Biology platform outputs demonstrated the presence of directional influence of each factor, in contrast to the IPA network wherein the linkage between molecular entities does not provide functional directionality between the interacting nodes. Thus, by employing an unbiased approach to data generation, integration and reverse engineering to create a computational model followed by simulation and differential network analysis, the Interrogative Biology discovery platform enables the understanding of hitherto unknown mechanisms in cancer pathophysiology that are in congruence with well-established scientific understandings of disease pathophysiology.

Figure 19:
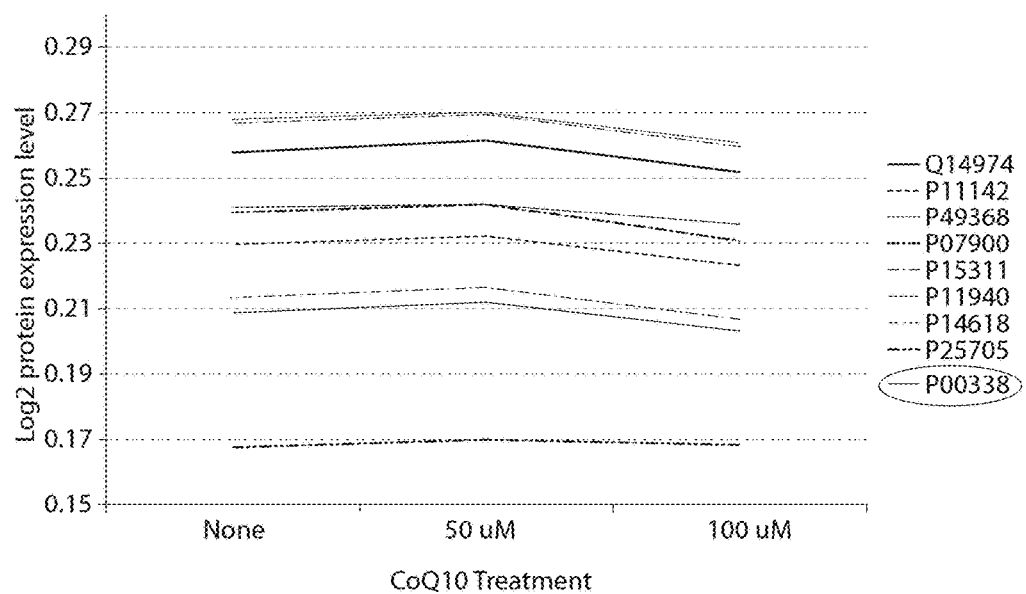
FIG. 19: Effect of CoQ10 treatments on downstream nodes.
Figure 20:
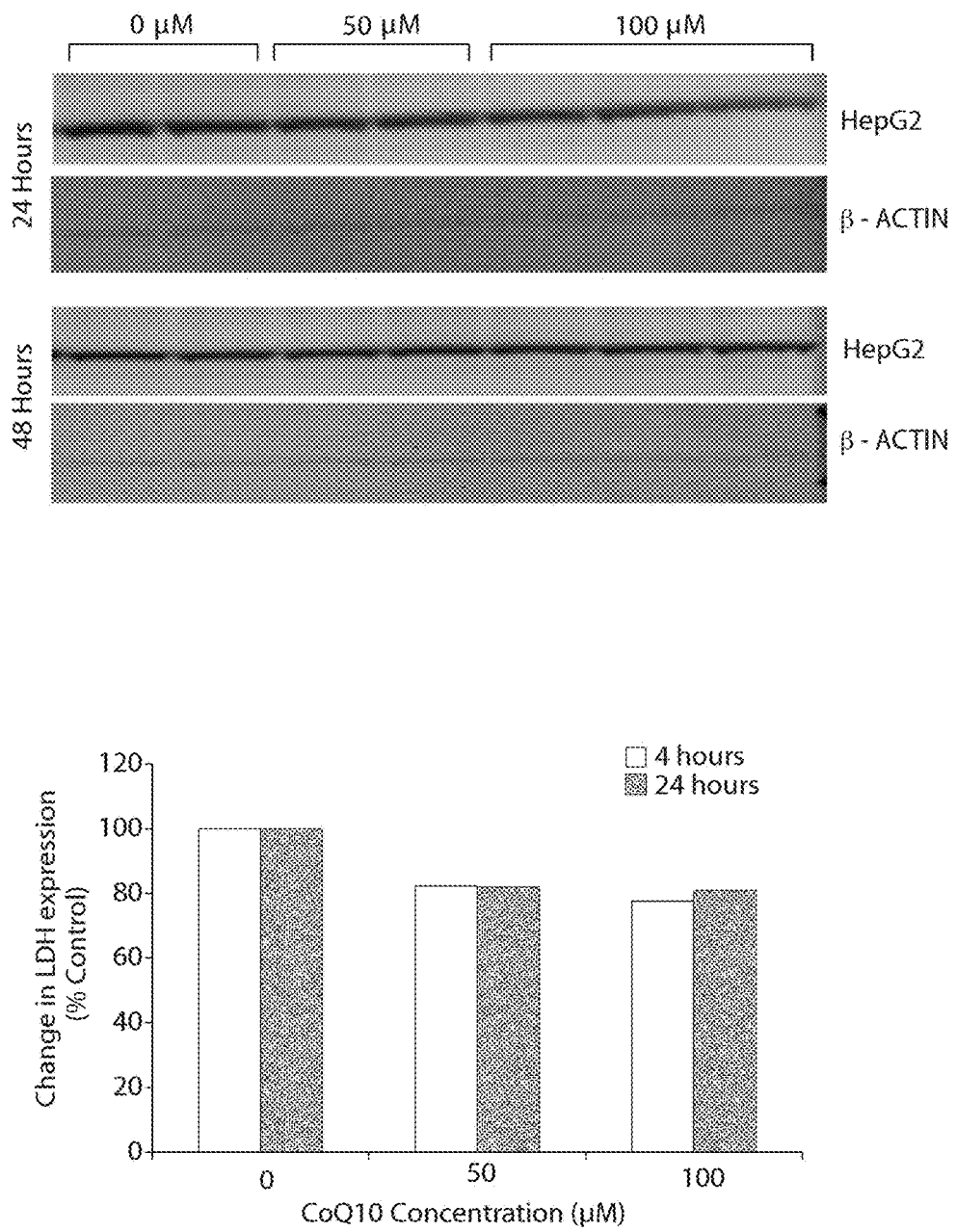
FIG. 20: CoQ10 treatment decreases expression of LDHA in cancer cell line HepG2.

FIG. 19 shows effect of CoQ10 treatment on downstream nodes (pubmed protein accession numbers are listed in FIG. 19) based on the protein expression data from iProfiling. Protein accession number P00338 is LDHA. Wet lab validation of proteomics data were performed for LDHA expression in HepG2 cells (see FIG. 20). As shown in FIG. 20, LDHA expression levels were decreased when HepG2 were treated with 50 uM CoQ10 or 100 uM CoQ10 for 24 or 48 hours.

Figure 24:
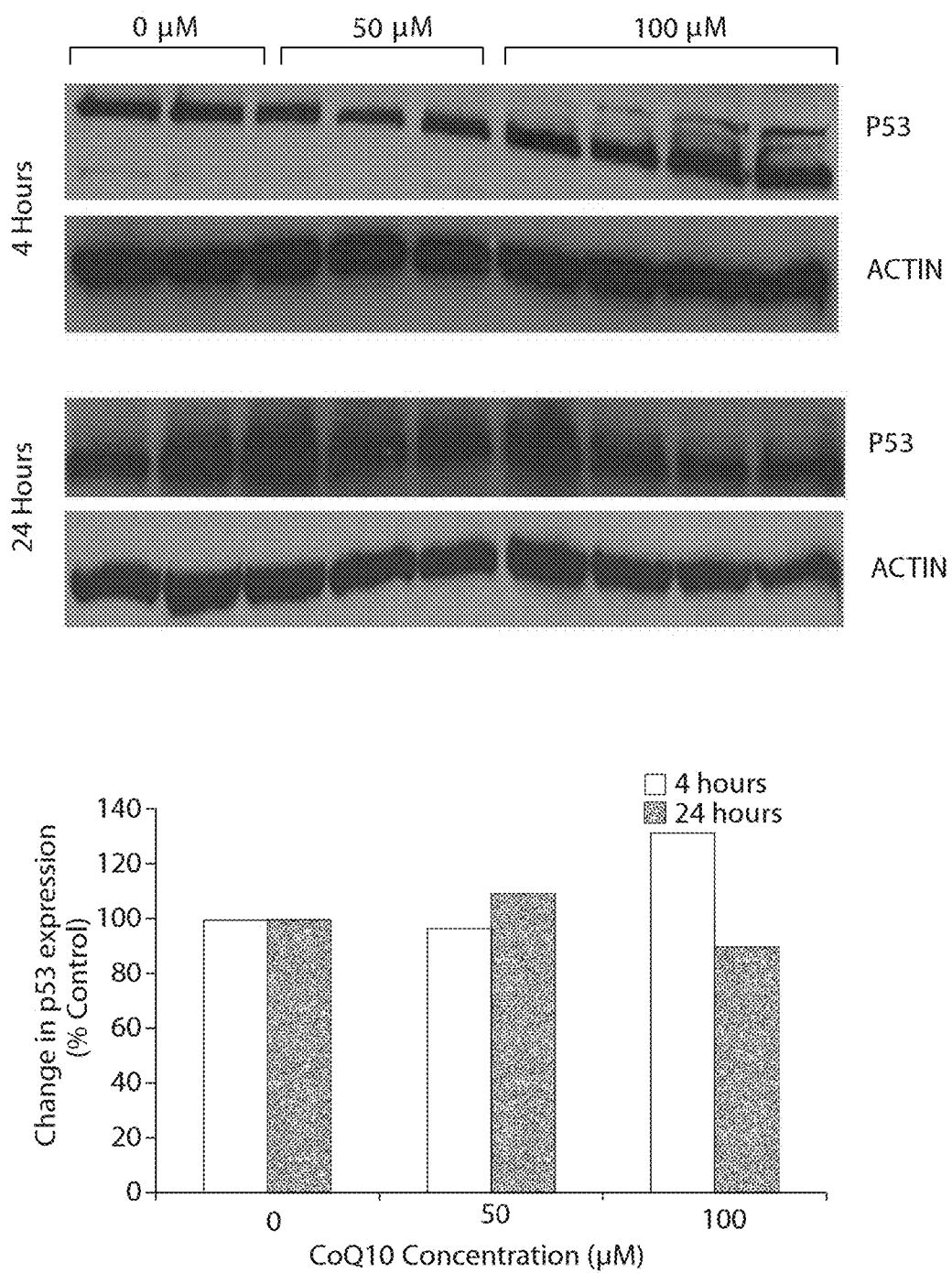
FIG. 24: Effect of CoQ10 treatment on TP53 expression levels in SKMEL28 cancer cell line.
Figure 25:
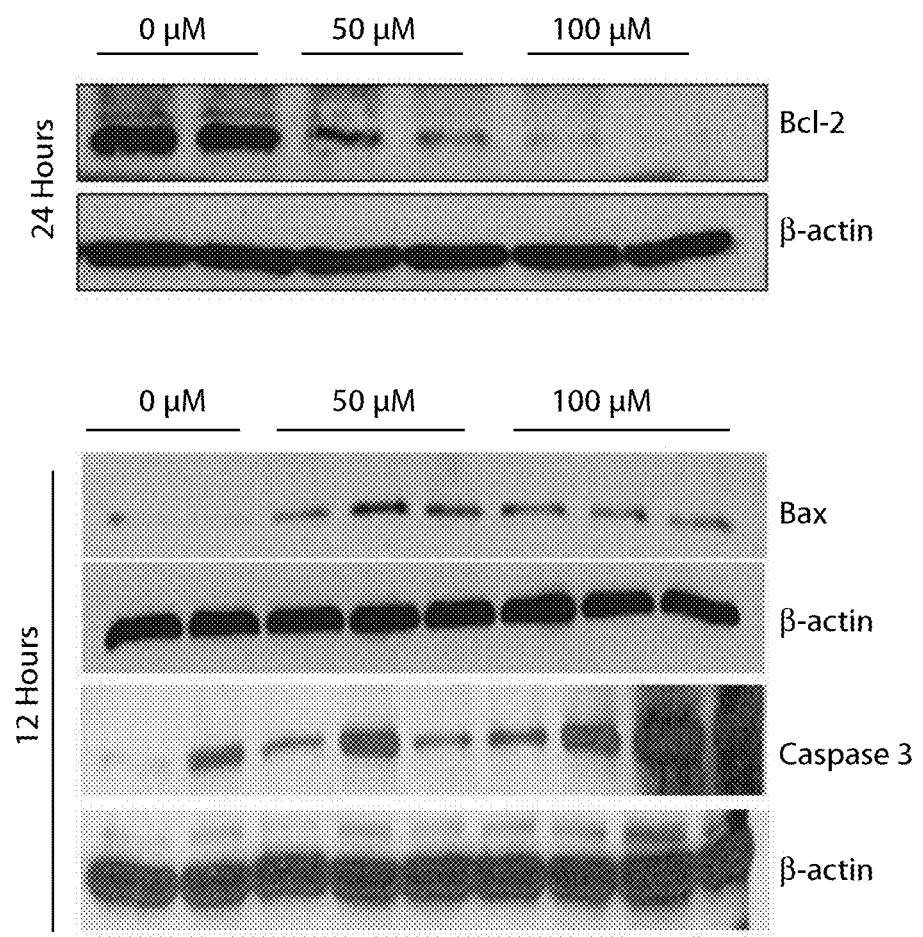
FIG. 25: Activation of TP53 associated with altered expression of BCL-2 proteins effectuating apoptosis in SKMEL28 cancer cell line and effect of CoQ10 treatment on Bcl-2, Bax and Caspase3 expression levels in SKMEL28.

For the well know cancer markers TP53, Bcl-2, Bax and Caspase3, wet lab validation of effects of CoQ10 treatment on these markers' expression level in SKMEL 28 cells were performed (see FIG. 24 and FIG. 25).

Example 2: Employing Platform Technology to Build a Cancer Delta-Delta Network

In this example, the platform technology described in detail above was employed to integrate data obtained from a custom built in vitro cancer model, and thereby identity novel proteins/pathways driving the pathogenesis of cancer. Relational maps resulting from this analysis have provided cancer treatment targets, as well as diagnostic/prognostic markers associated with cancer.

Briefly, four cancer lines (PaCa2, HepG2, PC3 and MCF7) and two normal cells lines (THLE2 and HDFa) were subject to various conditions simulating an environment experienced by cancer cells in vivo. Specifically, cells were exposed separately to each of hyperglycemic conditions, hypoxic conditions and treatment with lactic acid. For example, a hyperglycemic condition was created by culturing the cells in media containing 22 mM glucose. A hypoxic condition was induced by placing the cells in a Modular Incubator Chamber (MIC-101, Billups-Rothenberg Inc. Del Mar, Calif.), which was flooded with an industrial gas mix containing 5% $CO_2$, 2% $O_2$ and 93% nitrogen. For lactic acid treatment, each cell line was treated with 0 or 12.5 mM lactic acid. In addition to exposing the cells to each of the three foregoing conditions separately, cells were also exposed to combinations of two or all three of the conditions (i.e., hyperglycemic and hypoxic conditions; hyperglycemic condition and lactic acid; hypoxic condition and lactic acid; and, hyperglycemic and hypoxic conditions and lactic acid).

The cell model comprising the above-mentioned cells, wherein each type of cell was exposed to each condition described above, was additionally interrogated by exposing the cells to an environmental perturbation by treating with Coenzyme Q10. Specifically, the cells were treated with Coenzyme Q10 at 0, 50 μM or 100 μM.

Cell samples, as well as media samples containing the secretome from the cells, for each cell line exposed to each condition (or combination of conditions), with and without Coenzyme Q10 treatment, were collected at various times following treatment, including after 24 hours and 48 hours of treatment.

In addition, cross talk experiments between two different cancer cells, PaCa2 and HepG2 cells, were carried out in which PaCa2 and HepG2 cells were co-cultured. This co-culturing approach is referred to as an extracellular secretome (ECS) experiment. The first cell system (PaCa2) was seeded in the inserts of the wells of a transwell type growth chamber. Six well plates were generally used in order to enable better statistical analysis. At the time of seeding of the first cell system in the inserts, the inserts were placed in a separate 6-well plate. The second cell system (HepG2) was seeded in the primary tray. The 6-well plate containing the inserts, which contained the first cell system, and the primary tray containing the second cell system were incubated at 37° C. overnight. Each of the cell systems was grown in its respective cell specific media (wherein alternatively, each of the cell systems could be grown in a medium adapted to support the growth of both cell types). On the second day, the pre-determined treatment was given by media exchange. Specifically, the inserts containing the first cell system and the first cell system's respective media were placed into the primary tray containing the second cell system and the second cell system's respective media. In all cases of co-culture, however, co-cultured cells had been exposed to the same "cancer condition" (e.g., hyperglycemia, hypoxia, lactic acid, or combinations thereof), albeit separately, during the first day prior to co-culturing. That is, the first cell system in the inserts and the second cell system in the trays were exposed to the same condition before being moved to a "coculture" arrangement. The tray was then incubated for a pre-determined time period, e.g., 24 hour or 48 hours. Duplicate wells were set up with the same conditions, and cells were pooled to yield sufficient material for subsequent proteomic analysis. The media containing the secretome (1 ml aliquot), the cells from the inserts and the cells from the wells of the primary tray were harvested as separate samples. The experiments were conducted in triplicate in order to provide better statistical power.

Cross-talk experiments were also conducted by "media swap" experiments. Specifically, a cultured media or "secretome" from the first cell system (PaCa2) was collected after 24 hrs or 48 hrs following perturbation and/or conditioning and then added to the second cell system for 24-48 hrs. The final cultured media or "secretome" from the second cell system was then collected. All final secretomes were subjected to proteomic analysis.

Following the exposure of the cell system to the "cancer conditions" described above, the perturbation (i.e., Coenzyme Q10 treatment), and/or the conditions produced in the secretome of a paired cell from a co-culture experiment, the response of the cells was then analyzed by analysis of various readouts from the cell system. The readouts included proteomic data, specifically intracellular protein expression as well as proteins secreted into cell culture media, and functional data, specifically cellular bioenergetics.

iProfiling of changes in total cellular protein expression by quantitative proteomics was performed for cell and media samples collected for each cell line (normal and cancer cell lines) exposed to each condition (or combination of conditions), with or without the "environmental perturbation", i.e., Coenzyme Q10 treatment, using the techniques described above in the detailed description.

Further, bioenergetics profiling of each cell line (normal and cancer cell lines) exposed to each condition (or combination of conditions), with or without the "environmental perturbation", i.e., Coenzyme Q10 treatment, were generated by employing the Seahorse analyzer essentially as recommended by the manufacturer. Oxygen consumption rate (OCR) and Extracullular Acidification Rate (ECAR) were recorded by the electrodes in a 7 µl chamber created with the cartridge pushing against the seahorse culture plate.

Proteomics data collected for each cell line at each condition(s) and with/without each perturbation, and bioenergetics profiling data collected for each cell line at each condition(s) and with/without each perturbation, were then processed by the REFS™ system. A "composite cancer perturbed network" was generated from combined data obtained from all of the cancer cell lines, each having been exposed to each specific condition (and combination of conditions), and further exposed to perturbation (CoQ10). A "composite cancer unperturbed network" was generated from combined data obtained from all of the cancer cell lines, each having been exposed to each specific condition (and combination of conditions), without perturbation (without CoQ10). Similarly, a "composite normal perturbed network" was generated from combined data obtained from all of the normal cell lines, each having been exposed to each specific condition (and combination of conditions), and additionally exposed to perturbation (CoQ10). A "composite normal unperturbed network" was generated from combined data obtained from all of the normal cell lines, each having been exposed to each specific condition (and combination of conditions), without perturbation (without CoQ10).

Next, "simulation composite networks" (also referred to herein as "simulation networks") were generated for each of the four composite networks described above using REFS™. To accomplish this, each node in the given consensus composite network was simulated (by increasing or decreasing by 10-fold) to generate simulation networks using REFS™, as described in detail above in the detailed description.

The area under the curve and fold changes for each edge connecting a parent node to a child node in the simulation networks were extracted by a custom-built program using the R programming language, where the R programming language is an open source software environment for statistical computing and graphics.

Finally, delta networks were generated, where the delta networks represent the differential between two simulation composite networks. The delta networks were generated from the simulation composite networks. To generate a cancer vs. normal differential network in response to Coenzyme Q10 (delta-delta network), consecutive comparison steps were performed as illustrated in FIG. 26, by a custom built program using the PERL programming language.

Figure 26:
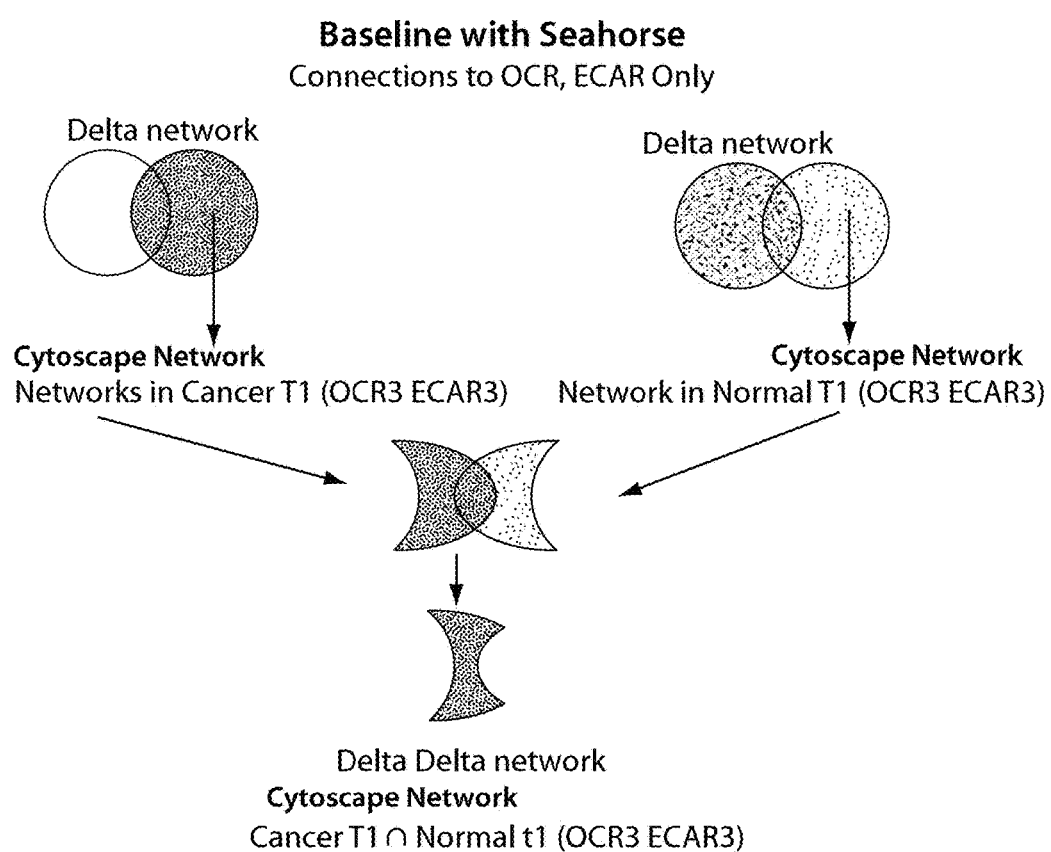
FIG. 26: Illustration of the mathematical approach towards generation of delta-delta networks.

First, cancer untreated (T0) and cancer treated (T1) networks were compared using the R program, and the unique Cancer treated T1 networks were separated (see the crescent shape in dark grey in FIG. 26). This represents the Cancer T1 ∩ (intersection) Cancer T0 "delta" network. Protein interaction/associations within this delta network can be viewed as representing the unique cancer response to Coenzyme Q10 treatment.

Similarly, normal untreated (T0) and normal treated (T1) networks were compared using the R program, and the unique normal treated T1 networks were separated (see the crescent shape in light grey in FIG. 26). This represents the Normal T1 ∩ Normal T0 "delta" network. Protein interactions/associations within this delta network can be viewed as representing the unique normal cell response to Coenzyme Q10 treatment.

Finally, unique Cancer T1 networks (see the crescent shape in dark grey in FIG. 26) and unique normal T1 networks (see the crescent shape in light grey in FIG. 26) were compared using the R program, and networks that are unique to cancer alone, and not present in normal cells, in response to Coenzyme Q10 were generated (see FIG. 26). This collection of protein interactions/associations represents the unique pathways within cancer cells that are not present in normal cells upon Coenzyme Q10 treatment. This collection of protein interactions/associations is called a "delta-delta network," since it is a differential map produced from a comparison of a differential map from cancer cells and a differential map from normal control cells.

Output from the PERL and R programs were input into Cytoscape, an open source program, to generate a visual representation of the Delta-Delta network.

The delta-delta networks identified using the method described herein are highly useful for identifying targets for cancer treatment. For example, according to the delta-delta network presented in FIG. 27, Protein A inhibits OCR3 (a measurement for oxydative phosphorylation) and enhances ECAR3 (a measurement for glycolysis). Since this interaction is unique in cancer cells (because the delta-delta network has subtracted any interactions that are commonly present in normal cells upon Coenzyme Q10 treatment), inhibiting the expression of protein A is expected to reduce glycolysis-based energy metabolism, which is a hallmark of the cancer metabolic pathway, and shift the cells towards an oxidative phosphorylation-based energy metabolism, which is a phenotype more closely associated with normal cells. Thus, a combination therapy using Coenzyme Q10 and protein A inhibitor is expected to be effective to treat cancer, at least in part by shifting the energy metabolism profile of the cancer cell to that which resembles a normal cell.

The advantage of the Interrogative Biology platform technology of the invention is further illustrated by the use of a substantive example wherein a sub-network derived from causal networks was compared to molecular network using IPA, a software program that utilizes neural networks to determine molecular linkage between experimental outputs to networks based on previously published literature. The causal sub-network containing PARK7 generated using the Interrogative Biology platform (shown in FIG. 29) is used as a substantive example. All molecular signatures of the PARK7 network from the Interrogative Biology platform were incorporated into IPA to generate a network based on known/existing literature evidence. The network outputs between the Interrogative Biology output and that generated by the use of IPA was then compared.

Figure 27:
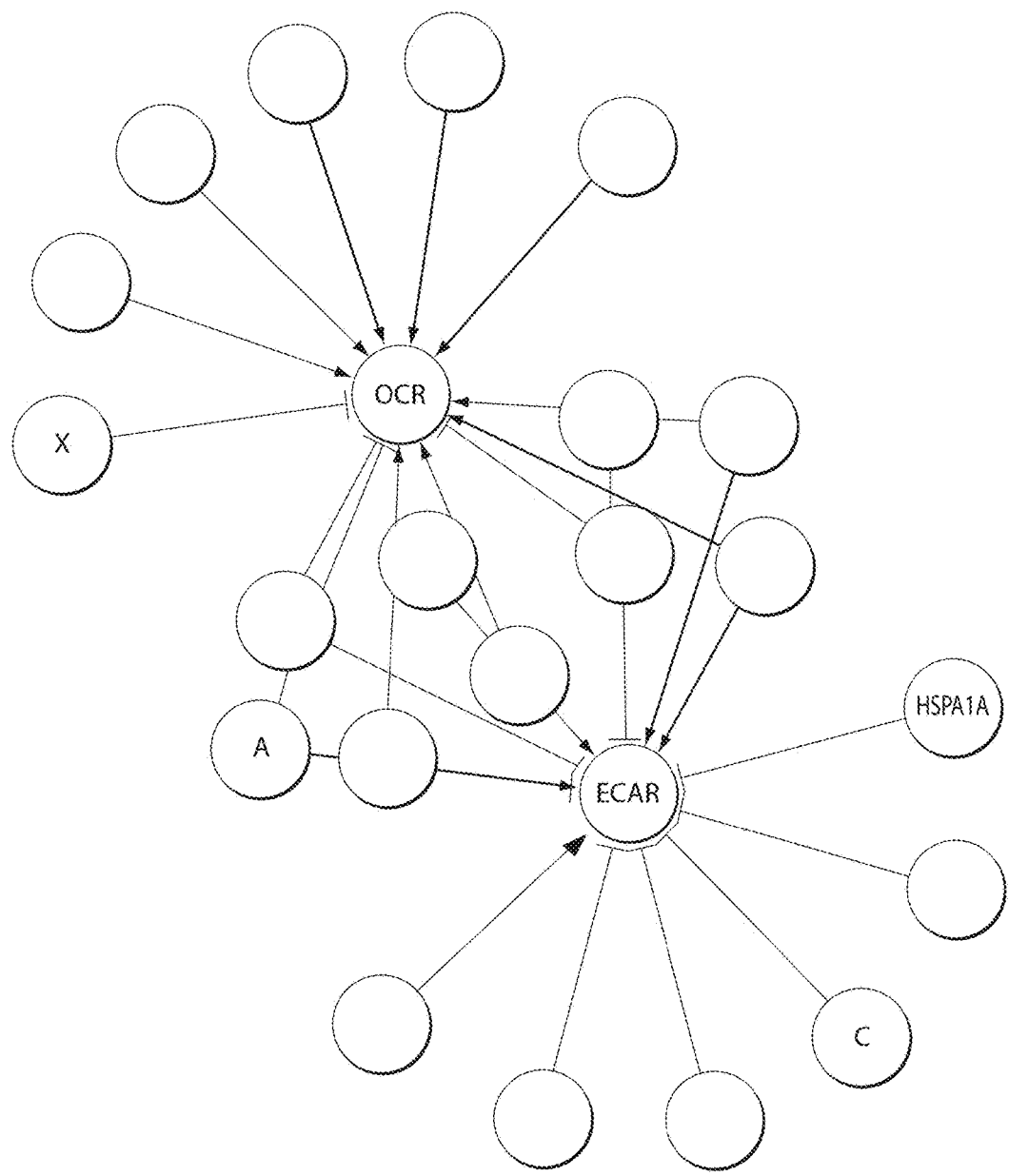
FIG. 27: Cancer-Healthy differential (delta-delta) network that drive ECAR and OCR. Each driver has differential effects on the end point as represented by the thickness of the edge. The thickness of the edge in cytoscape represents the strength of the fold change.
Figure 28:
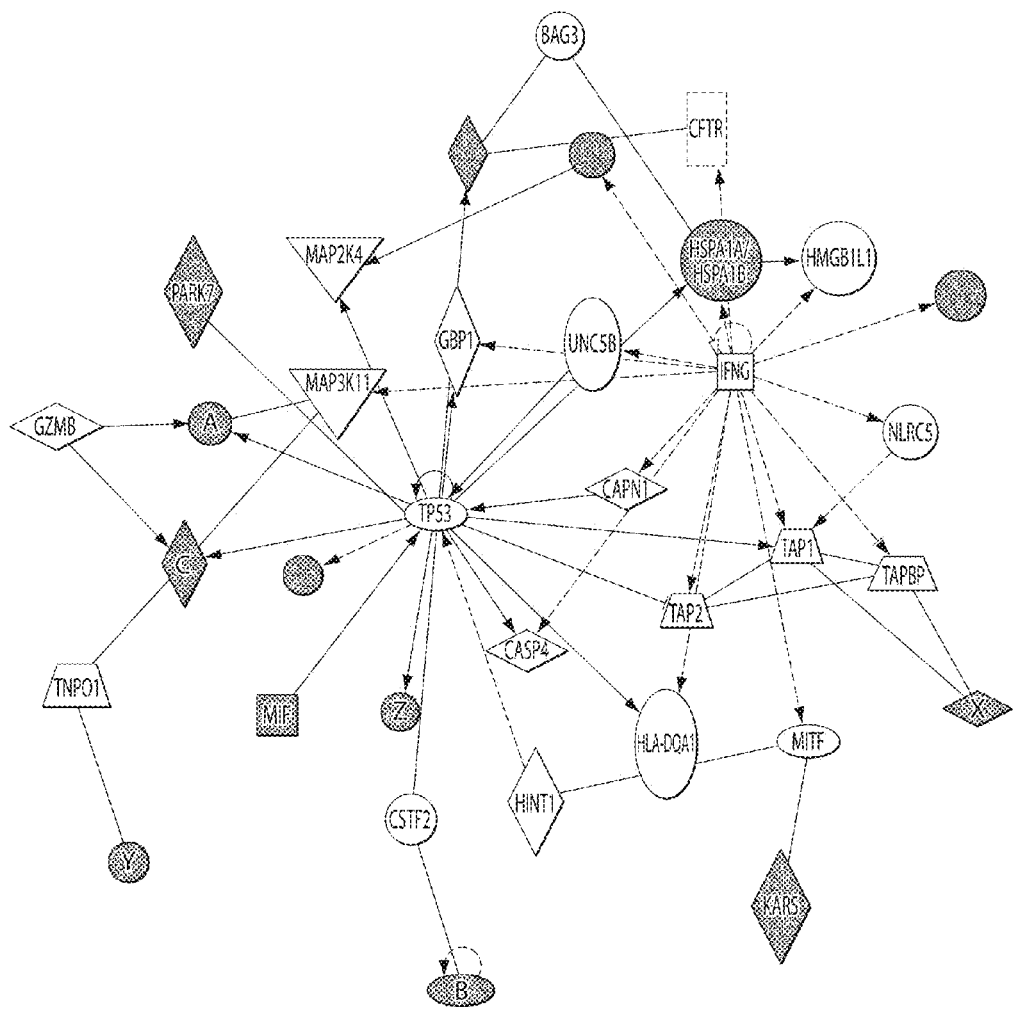
FIG. 28: Mapping PARK7 and associated nodes from the interrogative platform technology outputs using IPA: The gray shapes include all the nodes associated with PARK7 from the interrogative biology outputs that were imported into IPA. The unfilled shapes (with names) are new connections incorporated by IPA to create a complete map.
Figure 29:
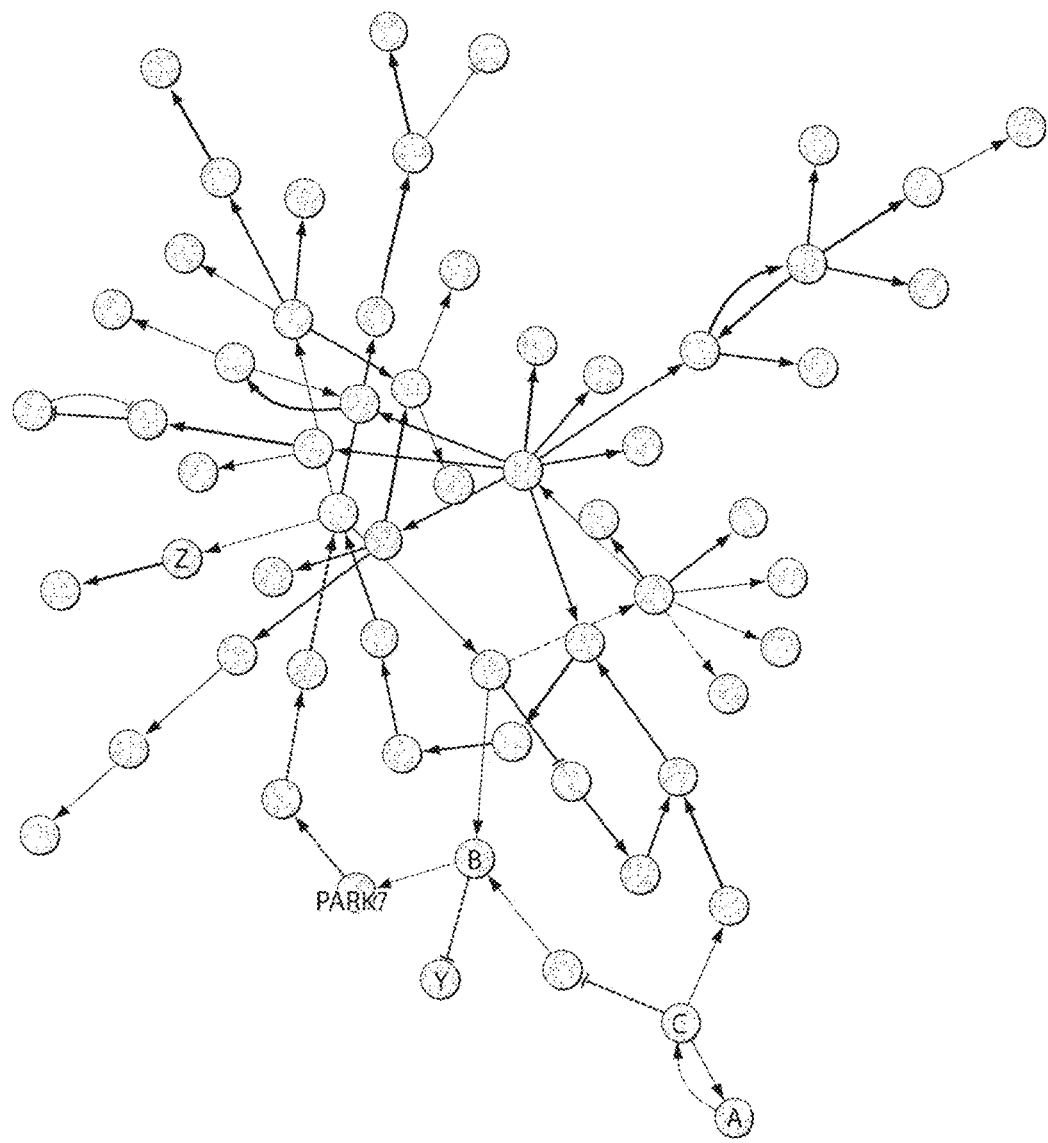
FIG. 29: The interrogative platform technology of the invention, demonstrating novel associations of nodes associated with PARK7. Edges shown in dashed lines are connections between two nodes in the simulations that have intermediate nodes, but do not have intermediate nodes in IPA. Edges shown in dotted lines are connections between two nodes in the simulations that have intermediate nodes, but have different intermediate nodes in IPA.

Six markers identified by the output from the Interrogative Biology platform technology (shown in FIG. 29), i.e. A, B, C, X, Y and Z in FIGS. 27-29, were observed to be connected to TP53 within the IPA generated network (FIG. 28). Among the six markers, A, B and C have been reported in the literature to be associated with cancer, as well as HSPA1A/HSPA1B. X, Y and Z were identified as "hubs" or key drivers of the cancer state, and are therefore identified as novel cancer markers. Further, MIF1 and KARS were also identified as "hubs" or key drivers of the cancer state, and are therefore identified as novel cancer markers. The fact that the factors identified by the use of the Interrogative Biology platform share connectivity with known factors published in the scientific literatures validated the accuracy of the network created by the use of the Interrogative Biology Platform. In addition, the network association within the PARK7 sub-network created by the use of the Interrogative Biology platform outputs (shown in FIG. 29) demonstrated the presence of directional influence of each factor, in contrast to the IPA network (shown in FIG. 28) wherein the linkage between molecular entities does not provide functional directionality between the interacting nodes. Furthermore, outputs from the Interrogative Biology platform (shown as dotted lines in FIG. 29) demonstrated the association of these components leading to a potential mechanism through PARK7. Protein C, Protein A and other nodes of PARK7 were observed to be key drivers of cancer metabolism (FIG. 27).

As evidenced by the present example, by employing an unbiased approach to data generation, integration and reverse engineering to create a computational model followed by simulation and differential network analysis, the Interrogative Biology discovery platform enables the understanding of hitherto unknown mechanisms in cancer pathophysiology that are in congruence with well-established scientific understandings of disease pathophysiology.

Example 3: Employing Platform Technology to Build a Diabetes/Obesity/Cardiovascular Disease Delta-Delta Network In this example, the platform technology described in detail above in the detailed description was employed to integrate data obtained from a custom built diabetes/obesity/cardiovascular disease (CVD) model, and to identity novel proteins/pathways driving the pathogenesis of diabetes/obesity/CVD. Relational maps resulting from this analysis have provided diabetes/obesity/CVD treatment targets, as well as diagnostic/prognostic markers associated with diabetes/obesity/CVD.

Five primary human cell lines, namely adipocytes, myotubes, hepatocytes, aortic smooth muscle cells (HASMC), and proximal tubular cells (HK2) were subject to one of five conditions simulating an environment experienced by these disease-relevant cells in vivo. Specifically, each of the five cell lines were exposed separately to each of the following conditions: hyperglycemic conditions, hyperlipidemic conditions, hyperinsulinemic conditions, hypoxic conditions and exposure to lactic acid. The hyperglycemic condition was induced by culturing cells in media containing 22 mM glucose. The hyperlipidemic condition was induced by culturing the cells in media containing 0.15 mM sodium palmitate. The hyperinsulinemic condition was induced by culturing the cells in media containing 1000 nM insulin. The hypoxic condition was induced by placing the cells in a Modular Incubator Chamber (MIC-101, Billups-Rothenberg Inc. Del Mar, Calif.), which was flooded with an industrial gas mix containing 5% $CO_2$, 2% $O_2$ and 93% nitrogen. Each cell line was also treated with 0 or 12.5 mM lactic acid.

In addition, cross talk experiments between two different pairs of cells, HASMC (cell system 1) and HK2 cells (cell system 2) or liver cells (cell system 1) and adipocytes (cell system 2) were carried out in which the paired cells were co-cultured. This co-culturing approach is referred to as an extracellular secretome (ECS) experiment. The first cell system (e.g., HASMC) was first seeded in the inserts of the wells of a transwell type growth chamber. Six well plates were used to enable better statistical analysis. At the time of seeding with the first cell system in the inserts, the inserts were placed in a separate 6-well plate. The second cell system (e.g., HK2) was seeded on the primary tray. The insert tray containing the first cell system and the primary tray containing the second cell system were incubated at 37° C. overnight. Each of the cell systems was grown in the specific cell specific media (wherein alternatively, each of the cell systems could be grown in a medium adapted to support the growth of both cell types). On the second day, the pre-determined treatment was given by media exchange. Specifically, the inserts containing the first cell system were placed into the primary tray containing the second cell system. The tray was then incubated for a pre-determined time period, e.g., 24 hour or 48 hours. Duplicate wells were set up with the same conditions, and cells were pooled to yield sufficient material for 2D analysis. The media (1 ml aliquot), the cells from the inserts and the cells from the wells of the primary tray were harvested as separate samples. The experiments were conducted in triplicate in order to provide better statistical analysis power.

Cross-talk experiments were also conducted by "media swap" experiments. Specifically, a cultured media or "secretome" from the first cell system, HASMC was collected after 24 hrs or 48 hrs following perturbation or conditioning and then added to the second cell system, Adipoctes, for 24-48 hrs. The final cultured media or "secretome" from the second cell system was then collected. All final secretomes were subjected to proteomic analysis.

The cell model comprising the above-mentioned cells, wherein the cells were exposed to each condition described above, was additionally "interrogated" by exposing the cells to an "environmental perturbation" by treating with Coenzyme Q10. Specifically, the cells were treated with Coenzyme Q10 at 0, 50 µM, or 100 µM.

Cell samples for each cell line, condition and Coenzyme Q10 treatment were collected at various times following treatment, including after 24 hours and 48 hours of treatment. For certain cells and under certain conditions, media samples were also collected and analyzed.

iProfiling of changes in total cellular protein expression by quantitative proteomics was performed for cell and media samples collected for each cell line at each condition and with each "environmental perturbation", i.e, Coenzyme Q10 treatment, using the techniques described above in the detailed description.

Proteomics data collected for each cell line listed above at each condition and with each perturbation, and bioenergetics profiling data collected for each cell line at each condition and with each perturbation, were then processed by the REFS™ system. A composite perturbed network was generated from combined data obtained from all the cell lines for one specific condition (e.g., hyperglycemia) exposed to perturbation (CoQ10). A composite unperturbed network was generated from combined data obtained from all of the cell lines for the same one specific condition (e.g., hyperglycemia), without perturbation (without CoQ10). Similarly, a composite perturbed network was generated from combined data obtained from all of the cell lines for a second, control condition (e.g., normal glycemia) exposed to perturbation (CoQ10). A composite unperturbed network was generated from combined data obtained from all of the cell lines for the same second, control condition (e.g., normal glycemia), without perturbation (without CoQ10).

Each node in the consensus composite networks described above was simulated (by increasing or decreasing by 10-fold) to generate simulation networks using REFS™, as described in detail above in the detailed description.

The area under the curve and fold changes for each edge connecting a parent node to a child node in the simulation networks were extracted by a custom-built program using the R programming language, where the R programming language is an open source software environment for statistical computing and graphics.

Delta networks were generated from the simulated composite networks. To generate a Diabetes/Obesity/Cardiovascular disease condition vs. normal condition differential network in response to Coenzyme Q10 (delta-delta network), steps of comparison were performed as illustrated in FIG. 30, by a custom built program using the PERL programming language.

Figure 30:
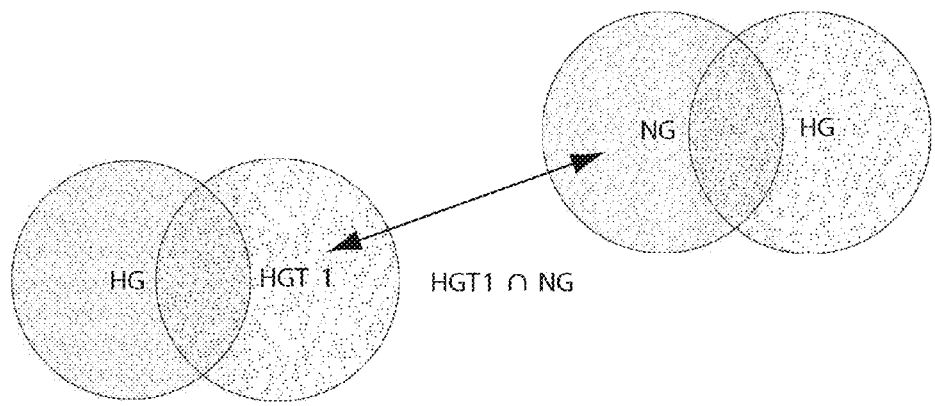
FIG. 30: Illustration of the mathematical approach towards generation of delta-delta networks. Compare unique edges from NG in the NG∩HG delta network with unique edges of HGT1 in the HG∩HGT1 delta network. Edges in the intersection of NG and HGT1 are HG edges that are restored to NG with T1.

Specifically, as shown in FIG. 30, Treatment T1 refers to Coenzyme Q10 treatment and NG and HG refer to normal and hyperglycemia as conditions. Unique edges from NG in the NG∩HG delta network was compared with unique edges of HGT1 in the HG∩HGT1 delta network. Edges in the intersection of NG and HGT1 are HG edges that are restored to NG with T1. HG edges restored to NG with T1 were superimposed on the NG∩HG delta network (shown in darker colored circles in FIG. 31)

Figure 31:
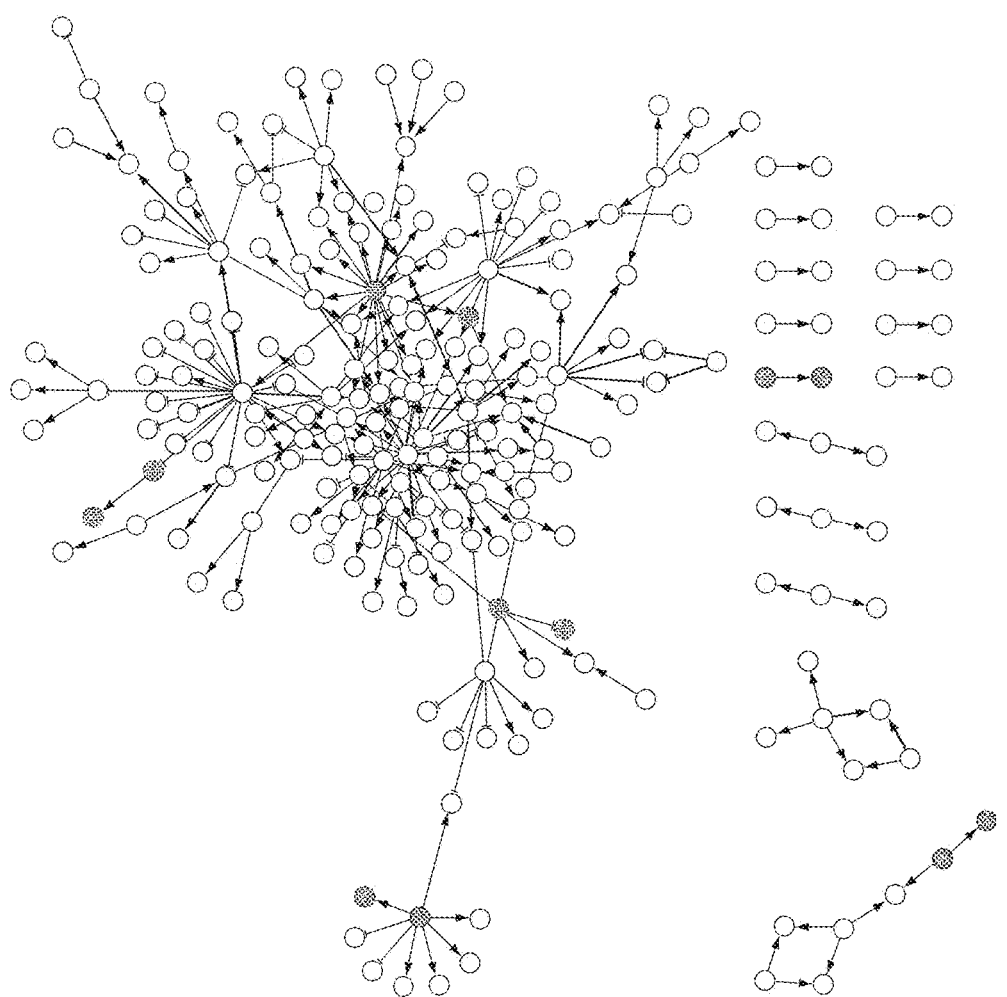
FIG. 31: Delta-delta network of diabetic edges restored to normal with Coenzyme Q10 treatment superimposed on the NG∩HG delta network.

Specifically, a simulated composite map of normal glycemia (NG) condition and a simulated composite map of hyperglycemia (HG) condition were compared using a custom-made Perl program to generate unique edges of the normal glycemia condition. A simulated composite map of hyperglycemia condition without Coenzyme Q10 treatment (HG) and a simulated map of hyperglycemia condition with Coenzyme Q10 treatment (HGT1) were compared using a custom-made Perl program to generate unique edges of the hyperglycemia condition with Coenzyme Q10 treatment (HGT1). Edges in the intersection of the unique edges from normal glycemia condition (NG) and the unique edges from hyperglycemia condition with Coenzyme Q10 treatment (HGT1) were identified using the Perl program. These edges represent factors/networks that are restored to normal glycemia condition from hyperglycemia condition by the treatment of Coenzyme Q10. The delta-delta network of hyperglycemic edges restored to normal with Coenzyme Q10 treatment was superimposed on the normal glycemia ∩ Hyperglycemia delta network. A sample of the superimposed networks is shown in FIG. 31. FIG. 31 is an exemplary diabetes/obesity/cardiovascular disease condition vs. normal condition differential network in response to Coenzyme Q10 (delta-delta network). Darker colored circles in FIG. 31 are identified edges which were restored to a normal glycemia condition from a hyperglycemia condition by the treatment of Coenzyme Q10. Lighter colored circles in FIG. 31 are identified unique normal hypercemia edges.

Output from the PERL and R programs were input into Cytoscape, an open source program, to generate a visual representation of the Delta-Delta network.

Figure 32:
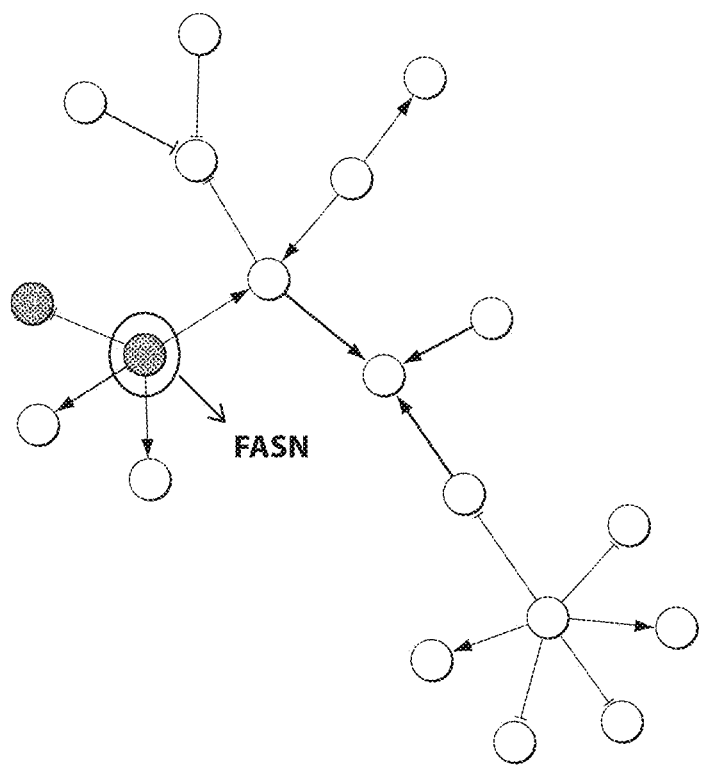
FIG. 32: Delta-delta network of hyperlipidemic edges restored to normal with Coenzyme Q10 treatment superimposed on the normal lipidemia ∩ Hyper lipidemia delta network.
Figure 33:
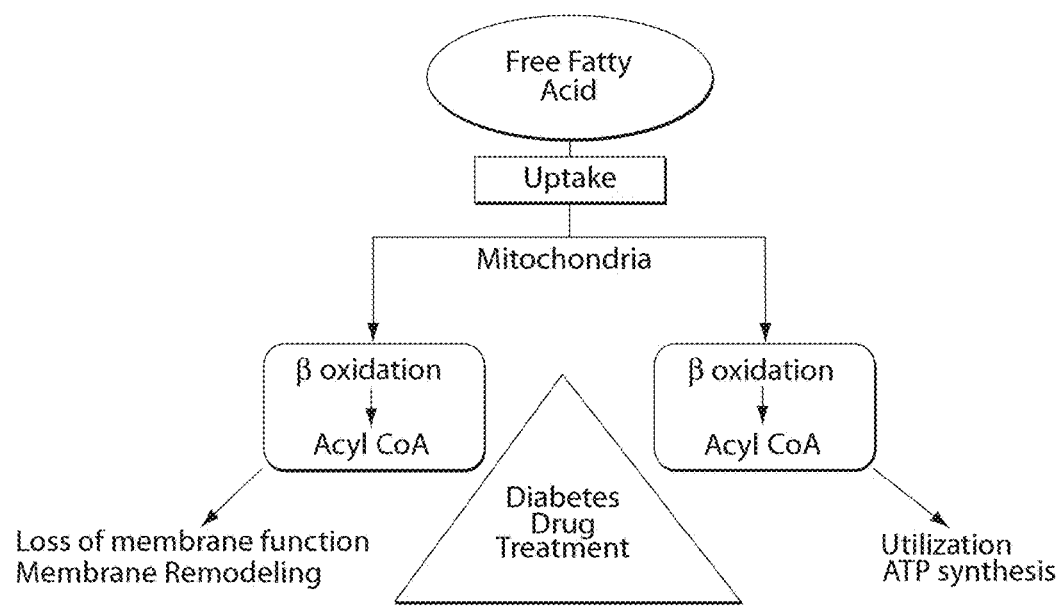
FIG. 33: A Schematic representing the altered fate of fatty acid in disease and drug treatment. A balance between utilization of free fatty acid (FFA) for generation of ATP and membrane remodeling in response to disruption of membrane biology has been implicated in drug induced cardiotoxicity.
Figure 34:
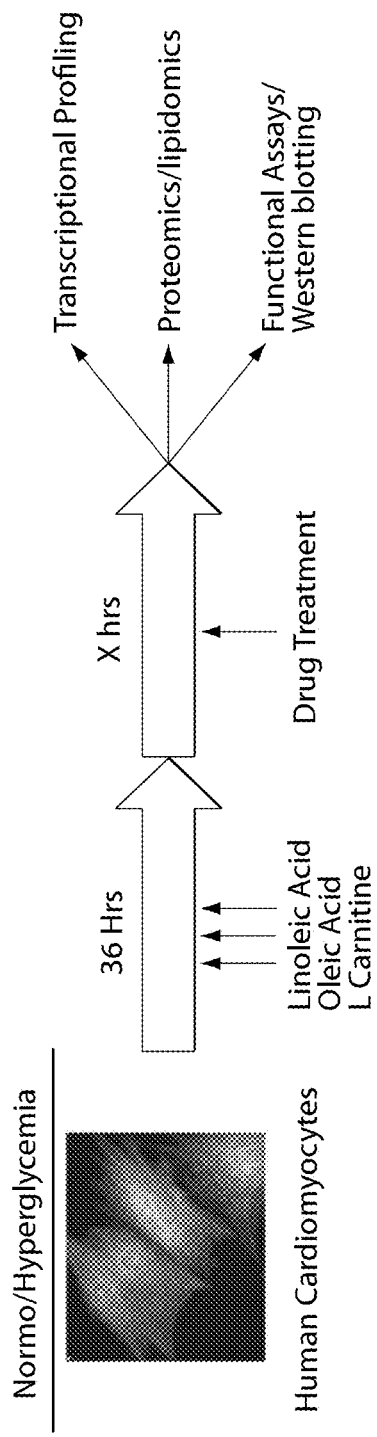
FIG. 34: A Schematic representing experimental design and modeling parameters used to study drug induced toxicity in diabetic cardiomyocytes.

Similarly to the experiments described above for hyperglycemia vs. normal glycemic condition, a simulated composite network of hyperlipidemia condition (combining data from all diabetes/obesity/cardiovascular-related cells described above) without Coenzyme Q10 treatment and a simulated composite network of hyperlipidemia condition (combining data from all diabetes/obesity/cardiovascular-related cells, described above) with Coenzyme Q10 treatment were compared using the Perl program to generate unique edges of the hyperlipidemia condition with Coenzyme Q10 treatment. Edges in the intersection of the unique edges from normal lipidemia condition and the unique edges from hyperlipidemic condition with Coenzyme Q10 treatment were identified using the Perl program. These edges represent factors/networks that are restored to a normal lipidemia condition from a hyperlipidemia condition by the treatment of Coenzyme Q10. A delta-delta network of hyperlipidemic edges restored to normal with Coenzyme Q10 treatment was superimposed on the normal lipidemia ∩ Hyperlipidemia delta network. A sample of the superimposed networks is shown in FIG. 32. Darker colored circles in FIG. 32 are identified edges which were restored to a normal lipidemia condition from a hyperlipidemia condition by the treatment of Coenzyme Q10. Lighter colored circles in FIG. 32 are identified unique normal lipidemia edges. FASN was identified as one important factor of a signaling pathway which modulates Coenzyme Q10's effect of restoring hyperlipidemia to a normal lipidemia condition.

Fatty acid synthase—fatty acid synthesis enzymes such as FASN have been implicated in almost all aspects of human metabolic alterations such as obesity, insulin resistance or dyslipidemia. FASN inhibitors have been proposed as lead molecules for treatment of obesity, althought molecular mechanisms are unknown (Mobbs et al 2002). Cerulenin and synthetic compound C75-FASN inhibitors have been shown to have an effect in reducing food intake and effectuate weight loss (Loftus et al 2000).

The fact that FASN was identified by the platform technology described herein as one important factor in the signaling pathway which modulates Coenzyme Q10's effect of restoring a diabetic to a normal state, as shown in FIG. 32, validated the accuracy of this delta-delta network. Therefore, other novel-factors identified in this delta-delta network will be potential therapeutic factors or drug targets for further investigation.

Example 4: Employing Platform Technology to Build Models of Drug Induced Cardiotoxicity In this example, the platform technology described in detail above in the detailed description was employed to integrate data obtained from a custom built cardiotoxicity model, and to identify novel proteins/pathways driving the pathogenesis/toxicity of drugs. Relational maps resulting from this analysis have provided toxicity biomarkers.

In the healthy heart contractile function depends on a balance of fatty acid and carbohydrate oxidation. Chronic imbalance in uptake, utilization, organellar biogenesis and secretion in non-adipose tissue (heart and liver) is thought to be at the center of mitochondrial damage and dysfunction and a key player in drug induced cardiotoxicity. Here Applicants describe a systems approach combining protein and lipid signatures with functional end point assays specifically looking at cellular bioenergetics and mitochondrial membrane function. In vitro models comprising diabetic and normal cardiomyocytes supplemented with excessive fatty acid and hyperglycemia were treated with a panel of drugs to create signatures and potential mechanisms of toxicity. Applicants demonstrated the varied effects of drugs in destabilizing the mitochondria by disrupting the energy metabolism component at various levels including (i) Dysregulation of transcriptional networks that controls expression of mitochondrial energy metabolism genes; (ii) Induction of GPAT1 and taffazin in diabetic cardiomyocytes thereby initiating de novo phospholipid synthesis and remodeling in the mitochondrial membrane; and (iii) Altered fate of fatty acid in diabetic cardiomyocytes, influencing uptake, fatty acid oxidation and ATP synthesis. Further, Applicants combined the power of wet lab biology and AI based data mining platform to generate causal network based on bayesian models. Networks of proteins and lipids that are causal for loss of normal cell function were used to discern mechanisms of drug induced toxicity from cellular protective mechanisms. This novel approach will serve as a powerful new tool to understand mechanism of toxicity while allowing for development of safer therapeutics that correct an altered phenotype.

Human cardiomyocytes were subject to conditions simulating an diabetic environment experienced by the disease-relevant cells in vivo. Specifically, the cells were exposed to hyperglycemic conditions and hyperlipidemia conditions. The hyperglycemic condition was induced by culturing cells in media containing 22 mM glucose. The hyperlipidemia condition was induced by culturing the cells in media containing 1 mM L-carnitine, 0.7 mM Oleic acid and 0.7 mM Linoleic acid.

The cell model comprising the above-mentioned cells, wherein the cells were exposed to each condition described above, was additionally "interrogated" by exposing the cells to an "environmental perturbation" by treating with a diabetic drug (T) which is known to cause cardiotoxicity, a rescue molecule (R) or both the diabetic drug and the rescue molecule (T+R). Specifically, the cells were treated with diabetic drug; or treated with rescue molecule Coenzyme Q10 at 0, 50 µM, or 100 µM; or treated with both of the diabetic drug and the rescue molecule Coenzyme Q10.

Cell samples from each condition with each perturbation treatment were collected at various times following treatment, including after 6 hours of treatment. For certain conditions, media samples were also collected and analyzed. iProfiling of changes in total cellular protein expression by quantitative proteomics was performed for cell and media samples collected for each condition and with each "environmental perturbation", i.e, diabetic drug treatment, Coenzyme Q10 treatment or both, using the techniques described above in the detailed description. Transcriptional profiling experiments were carried out using the Biorad cfx-384 amplification system. Following data collection (Ct), the final fold change over control was determined using the δCt method as outlined in manufacturer's protocol. Lipidomics experiments were carried out using mass spectrometry. Functional assays such as Oxygen consumption rate OCR were measured by employing the Seahorse analyzer essentially as recommended by the manufacturer. OCR was recorded by the electrodes in a 7 µl chamber created with the cartridge pushing against the seahorse culture plate.

Figure 35:
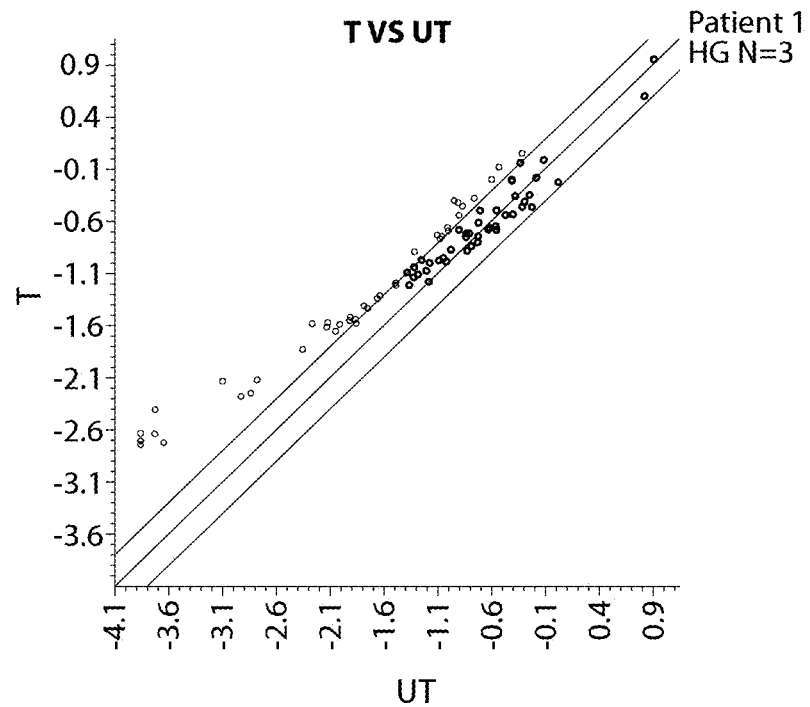
FIG. 35: Dysregulation of transcriptional network and expression of human mitochondrial energy metabolism genes in diabetic cardiomyocytes by drug treatment (T): rescue molecule (R) normalizes gene expression.
Figure 35:
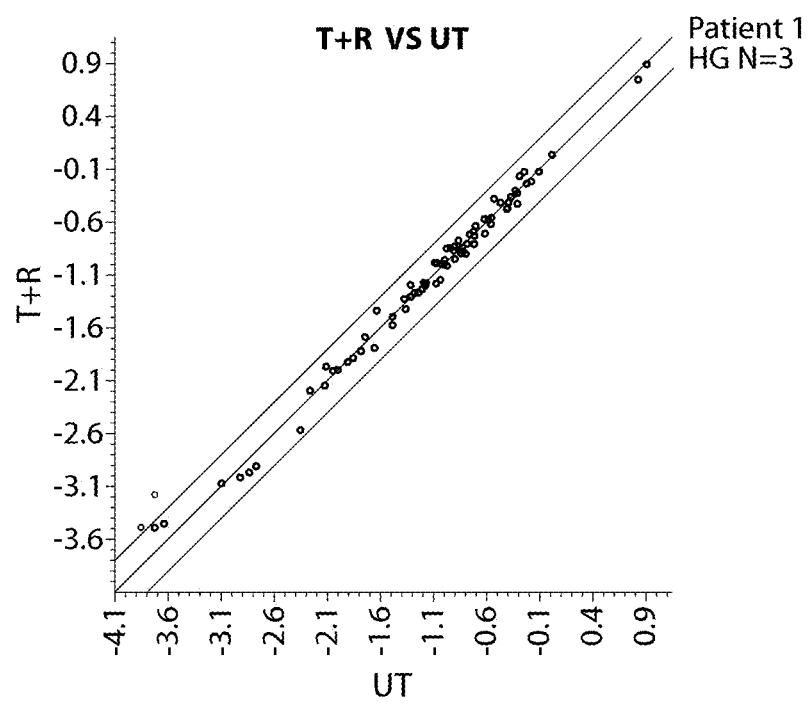

As shown in FIG. 35, transcriptional network and expression of human mitochondrial energy metabolism genes in diabetic cardiomyocytes (cardiomyocytes conditioned in hyperglycemic and hyperlipidemia) were compared between perturbed and unperturbed treatments. Specifically, data of transcriptional network and expression of human mitochondrial energy metabolism genes were compared between diabetic cardiomyocytes treated with diabetic drug (T) and untreated diabetic cardiomyocytes samples (UT). Data of Transcriptional network and expression of human mitochondrial energy metabolism genes were compared between diabetic cardiomyocytes treated with both diabetic drug and rescue molecule Coenzyme Q10 (T+R) and untreated diabetic cardiomyocytes samples (UT). Comparing to data from untreated diabetic cardiomyocytes, certain genes expression and transcription were altered when diabetic cardiomyocytes were treated with diabetic drug. Rescue molecule Coenzyme Q10 was demonstrated to reverse the toxic effect of diabetic drug and normalize gene expression and transcription.

Figure 36A:
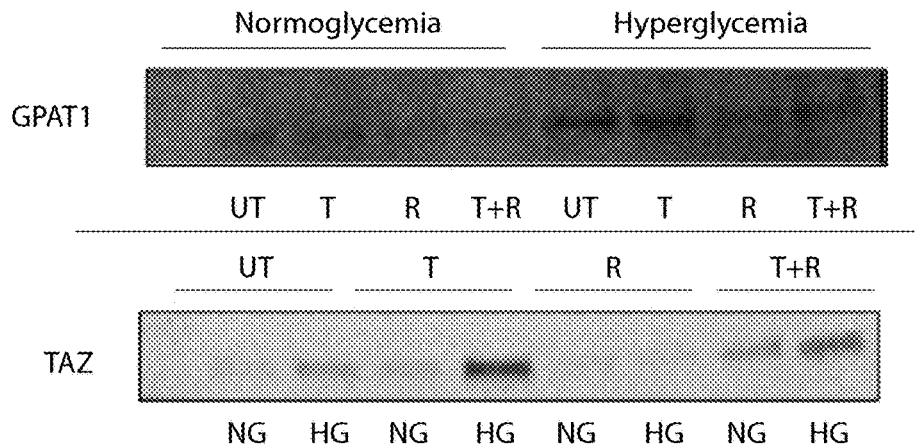
FIG. 36: A. Drug treatment (T) induced expression of GPAT1 and TAZ in mitochondria from cardiomyocytes conditioned in hyerglycemia. In combination with the rescue molecule (T+R) the levels of GPAT1 and TAZ were normalized. B. Synthesis of TAG from G3P.
Figure 36B:
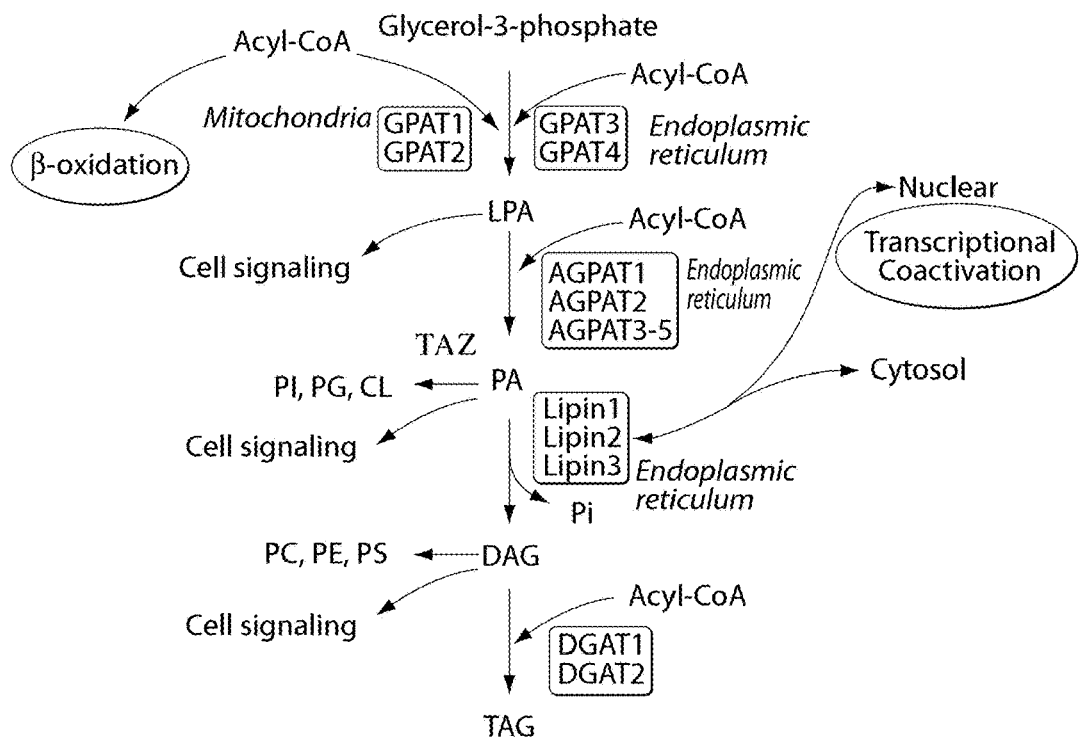

As shown in FIG. 36A, cardiomyocytes were cultured either in normoglycemia (NG) or hyperglygemia (HG) condition and treated with either diabetic drug alone (T) or with both diabetic drug and rescue molecule Coenzyme Q10 (T+R). Protein expression levels of GPAT1 and TAZ for each condition and each treatment were tested with western blotting. Both GPAT1 and TAZ were upregulated in hyperglycemia conditioned and diabetic drug treated cardiomyocytes. When hyperglycemia conditioned cardiomyocytes were treated with both diabetic drug and rescue molecule Coenzyme Q10, the upregulated protein expression level of GPAT1 and TAZ were normalized.

Figure 37A:
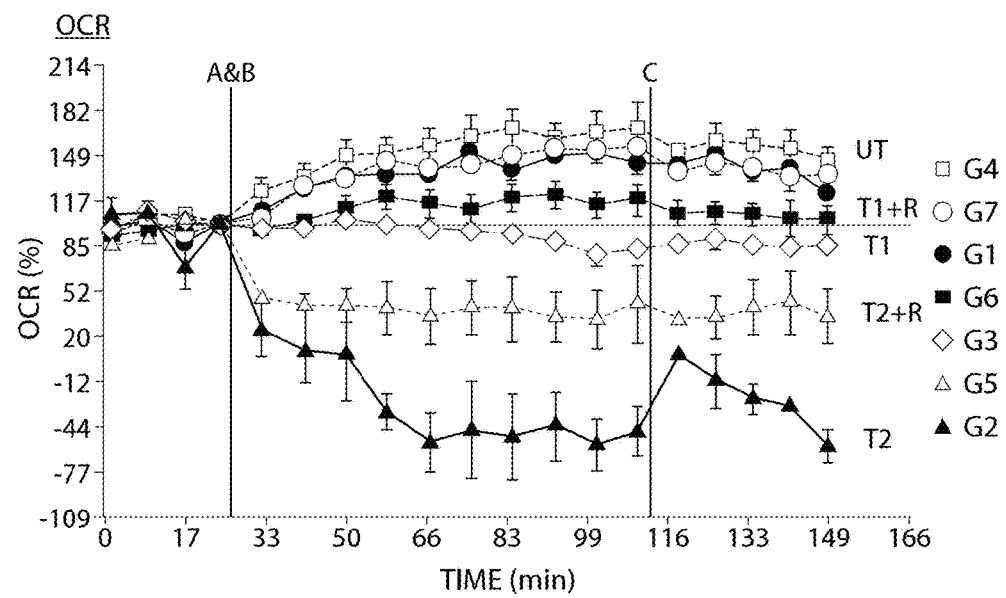
FIG. 37: A. Drug treatment (T) decreases mitochondrial OCR (oxygen consumption rate) in cardiomyocytes conditioned in hyperglycemia. The rescue molecule (T+R) normalizes OCR. B. Drug treatment (T) represses mitochondrial ATP synthesis in cardiomyocytes conditioned in hyperglycemia.

As shown in FIG. 37A, mitochondrial oxygen consumption rate (%) experiments were carried out for hyperglycemia conditioned cardiomyocytes samples. Hyperglycemia conditioned cardiomyocytes were either untreated (UT), treated with diabetic drug T1 which is known to cause cardiotoxicity, treated with diabetic drug T2 which is known to cause cardiotoxicity, treated with both diabetic drug T1 and rescue molecule Coenzyme Q10 (T1+R), or treated with both diabetic drug T2 and rescue molecule Coenzyme Q10 (T2+R). Comparing to untreated control samples, mitochondrial OCR was decreased when hyperglycemia conditioned cardiomyocytes were treated with diabetic drug T1 or T2. However, mitochondrial OCR was normalized when hyperglycemia conditioned cardiomyocytes were treated with both diabetic drug and rescue molecule Coenzyme Q10 (T1+R, or T2+R).

Figure 37B:
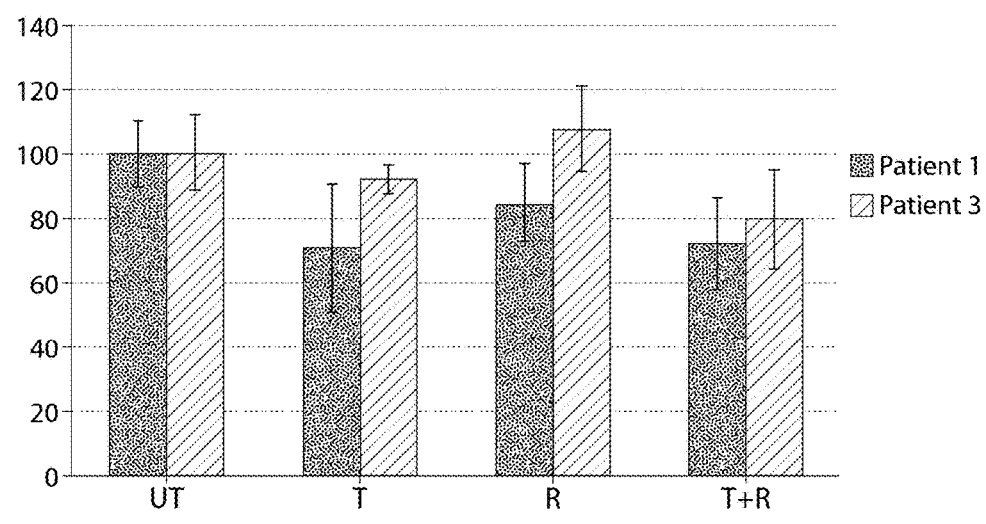

As shown in FIG. 37B, mitochondria ATP synthesis experiments were carried out for hyperglycemia conditioned cardiomyocytes samples. Hyperglycemia conditioned cardiomyocytes were either untreated (UT), treated with a diabetic drug (T), or treated with both diabetic drug and rescue molecule Coenzyme Q10 (T+R). Comparing to untreated control samples, mitochondrial ATP synthesis was repressed when hyperglycemia conditioned cardiomyocytes were treated with diabetic drug (T).

Figure 38:
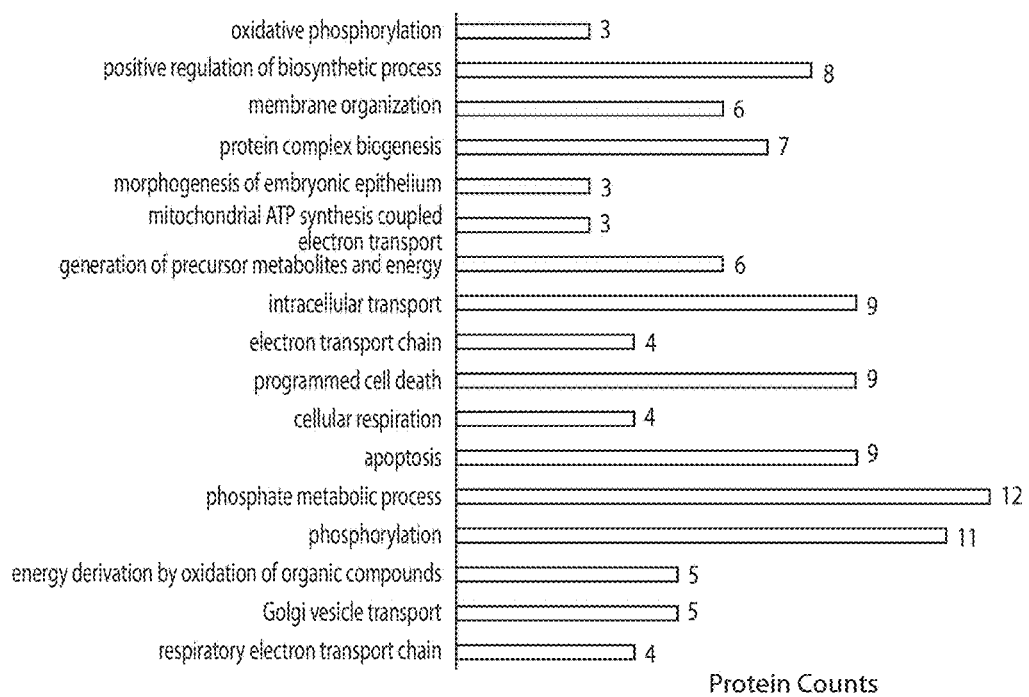
FIG. 38: GO Annotation of proteins down regulated by drug treatment. Proteins involved in mitochondrial energy metabolism were down regulated with drug treatment.

As shown in FIG. 38, based on the collected proteomic data, proteins down regulated by drug treatment were annotated with G0 terms. Proteins involved in mitochondrial energy metabolism were down regulated when hyperglycemia conditioned cardiomyocytes were treated with a diabetic drug which is known to cause cardiotoxicity.

Proteomics, lipidomics, transcriptional profiling, functional assays, and western blotting data collected for each condition and with each perturbation, were then processed by the REFS™ system. Composite perturbed networks were generated from combined data obtained from one specific condition (e.g., hyperglycemia, or hyperlipidemia) exposed to each perturbation (e.g., diabetic drug, CoQ10, or both). Composite unperturbed networks were generated from combined data obtained from the same one specific condition (e.g., hyperglycemia, or hyperlipidemia), without perturbation (untreated). Similarly, composite perturbed networks were generated from combined data obtained for a second, control condition (e.g., normal glycemia) exposed to each perturbation (e.g., diabetic drug, CoQ10, or both). Composite unperturbed networks were generated from combined data obtained from the same second, control condition (e.g., normal glycemia), without perturbation (untreated).

Each node in the consensus composite networks described above was simulated (by increasing or decreasing by 10-fold) to generate simulation networks using REFS™, as described in detail above in the detailed description.

The area under the curve and fold changes for each edge connecting a parent node to a child node in the simulation networks were extracted by a custom-built program using the R programming language, where the R programming language is an open source software environment for statistical computing and graphics.

Delta networks were generated from the simulated composite networks. To generate a drug induced toxicity condition vs. normal condition differential network in response to the diabetic drug (delt network), steps of comparison were performed as illustrated in FIG. 39, by a custom built program using the PERL programming language.

Figure 39:
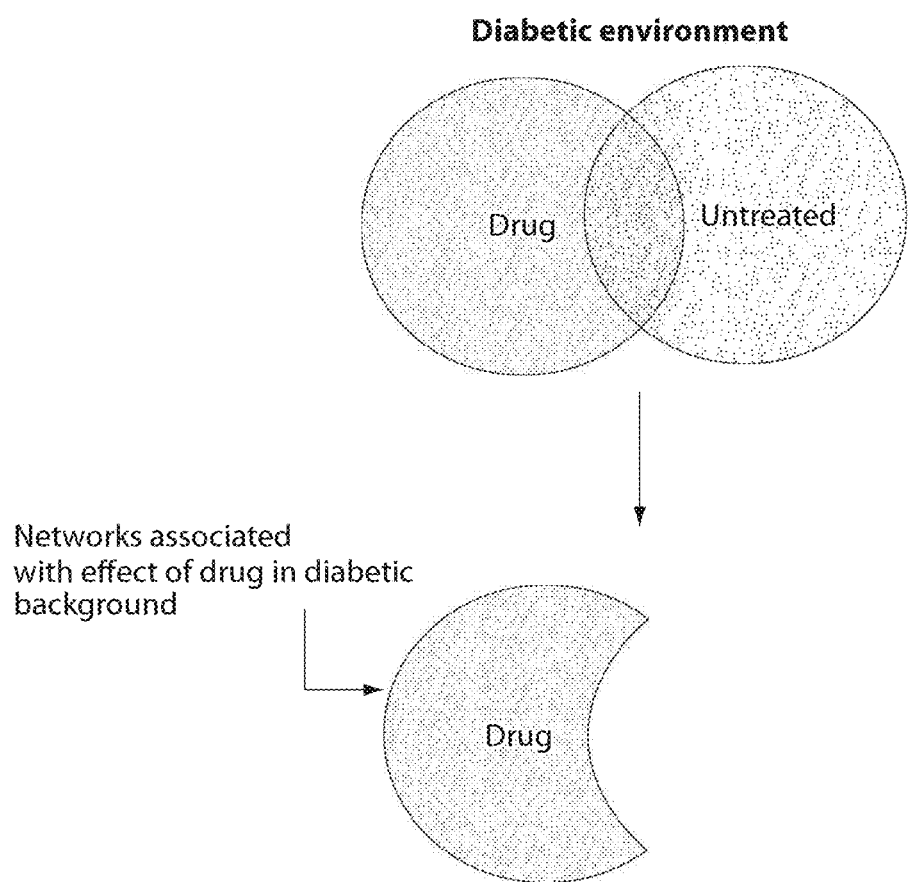
FIG. 39: Illustration of the mathematical approach towards generation of delta networks. Compare unique edges from T versus UT both the models being in diabetic environment.

Specifically, as shown in FIG. 39, UT refers to protein expression networks of untreated control cardiomyocytes in hyperglycemia condition. Treatment T refers to protein expression networks of diabetic drug treated cardiomyocytes in hyperglycemia condition. Unique edges from T in the UT∩T delta network are presented in FIG. 40.

Figure 40:
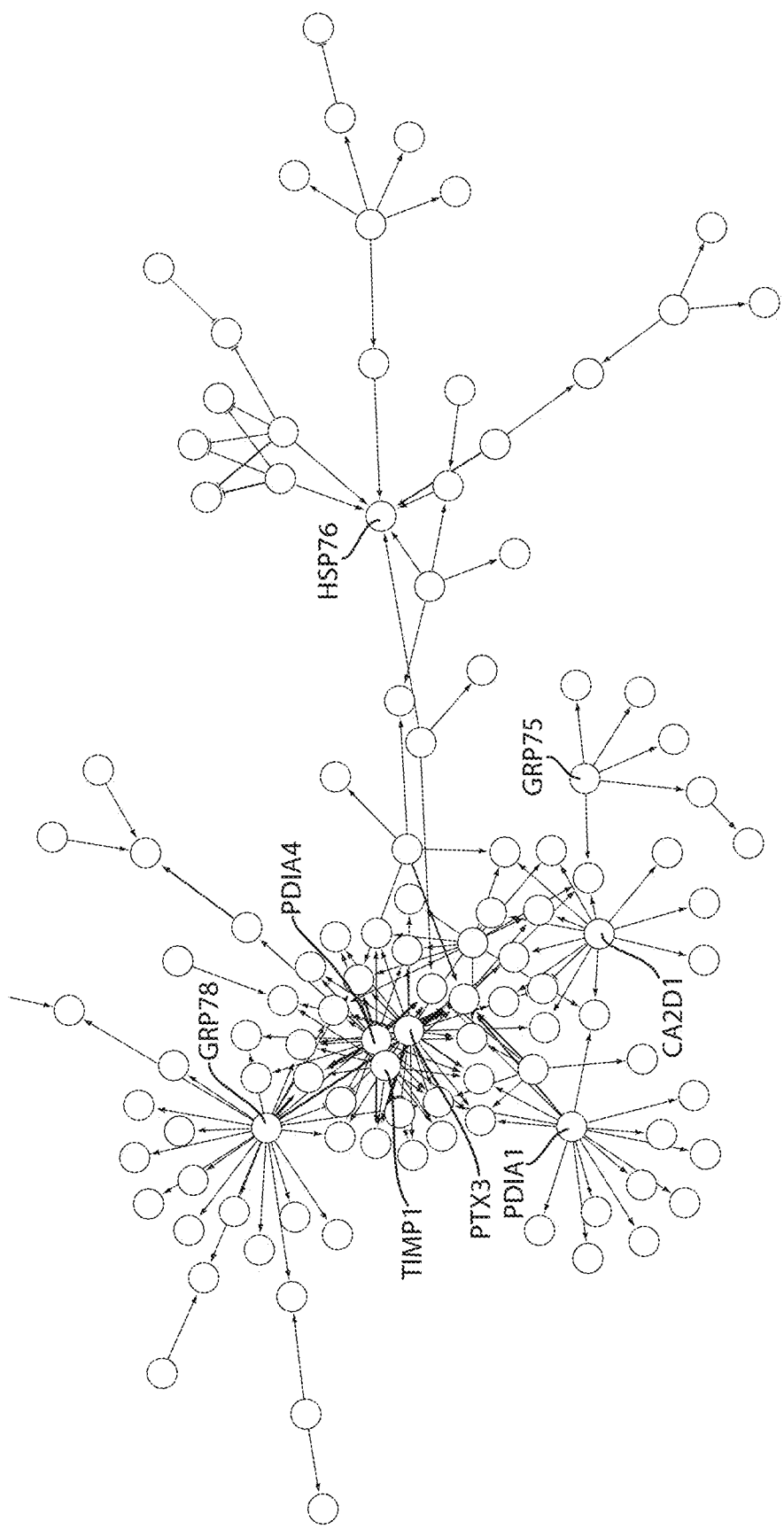
FIG. 40: A schematic representing potential protein hubs and networks that drive pathophysiology of drug induced toxicity.

Specifically, a simulated composite map of untreated cardiomyocytes in hyperglycemia condition and a simulated composite map of diabetic drug treated cardiomyocytes in hyperglycemia condition were compared using a custom-made Perl program to generate unique edges of the diabetic drug treated cardiomyocytes in hyperglycemia condition. Output from the PERL and R programs were input into Cytoscape, an open source program, to generate a visual representation of the delta network. As shown in FIG. 40, the network represents delta networks that are driven by the diabetic drug versus untreated in cardiomyocytes/cardiotox models in hyperglycemia condition.

From the drug induced toxicity condition vs. normal condition differential network shown in FIG. 40, proteins were identified which drive pathophysiology of drug induced cardiotoxicity, such as GRP78, GRP75, TIMP1, PTX3, HSP76, PDIA4, PDIA1, CA2D1. These proteins can function as biomarkers for identification of other cardiotoxicity inducing drugs. These proteins can also function as biomarkers for identification of agents which can alleviate cardiotoxicity.

The experiments described in this Example demonstrate that perturbed membrane biology and altered fate of free fatty acid in diabetic cardiomyocytes exposed to drug treatment represent the center piece of drug induced toxicity. Data integration and network biology have allowed for an enhanced understanding of cardiotoxicity, and identification of novel biomarkers predictive for cardiotoxicity.

Example 5: Employing Platform Technology to Implement Multi Proteomics Models for Elucidating Enzymatic Activity In general, the platform technology described in Example 1-4 above can be adapted to implement further methods for identifying a modulator of a biological system or disease process. The methods employ a model for the biological system, using cells associated with the biological system, to represents a characteristic aspect of the biological system. The model is used to obtain at least three levels of data, namely (i) a first data set representing global enzyme activity in the cells associated with the biological system, (ii) a second data set representing an effect of the global enzyme activity on the enzyme metabolites or substrates in the cells associated with the biological system, and (iii) a third data set representing global proteomic changes in the cells associated with the biological system. The data is used to generate a consensus causal relationship network among the global enzyme activity, the effect of the global enzyme activity, and the global proteomic changes. The consensus causal relationship network is based solely on the first, second, and third data sets using a programmed computing device (i.e., not based on any other known biological relationship). The consensus causal relationship network is then used to identify a causal relationship unique to the biological system, where at least one gene or protein associated with the unique causal relationship is identified as a modulator of the biological system or disease process.

In this example, the platform technology was adapted to implement multi proteomics techniques for measuring enzyme activity and the direct effects of that activity on the proteome, thereby, provide a system that can be used to understand causal relationships between enzymes and their metabolites/substrates in the context of global changes in the cellular proteome. Such techniques can provide valuable insight because, as demonstrated in this example, enzyme activity can be orthogonal to enzyme expression (e.g., activity down regulated and expression unregulated). Relational maps resulting from such an analysis can provide disease treatment targets, as well as diagnostic/prognostic markers associated with disease. Such targets and markers can provide for therapeutic compositions and methods. Techniques for establishing models, obtaining data sets, generating consensus causal relationship networks, and identifying causal relationship unique to the biological system are discussed in the summary, detailed description, and examples above. Further techniques for establishing models and obtaining data sets representing global enzyme activity and the effect of the global enzyme activity on the enzyme metabolites or substrates are provided below.

Figure 41A:
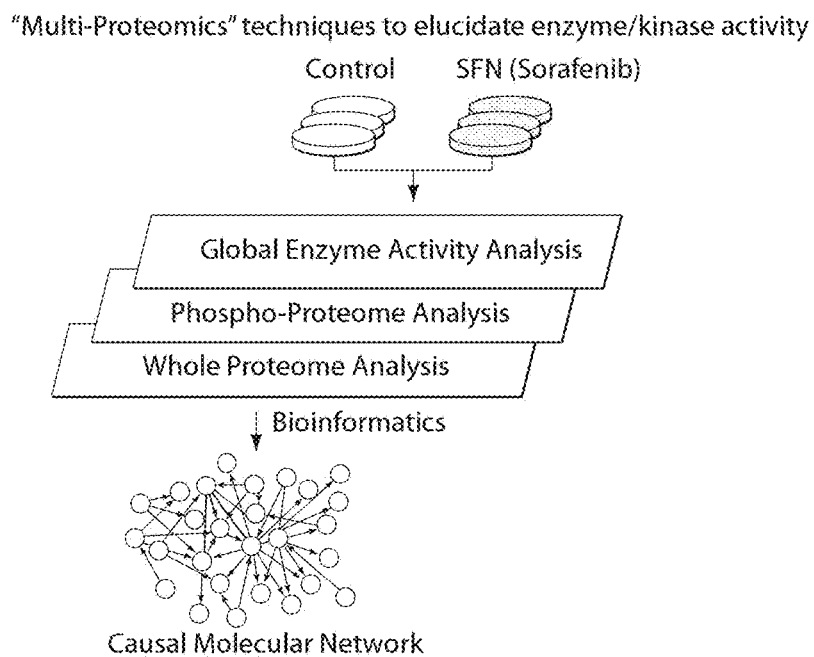
FIG. 41 illustrates a method for identifying a modulator of a biological system or disease process.

FIG. 41A illustrates a method for identifying a modulator of a biological system or disease process, which employs multi proteomic techniques for elucidating enzyme (e.g., kinase) activity. First, a model is established in accordance with the platform technology wherein cell lines are subjected to conditions simulating a disease and interrogated by exposure to an environmental perturbation (e.g., exposure to Sorafenib in the specific example of hepatocellular carcinoma provided below). A control is provided for comparison. Second, enzyme activity and its downstream effects are tracked in the context of global proteomic changes by analyzing (i) global enzymatic activity, (ii) the specific effect of the enzymatic activity on the proteome (e.g., the metabolites/substrates of the enzymatic activity), and (iii) the global effect on the cellular proteome. Third, the datasets are analyzed in accordance with the platform technology to identify modulators of interest. For example, a cancer model can be interrogated by a known anti-cancer drug kinase inhibitor; the effects of this perturbation to the system on the global kinase activity can be analyzed, along with the resulting effects on the phospho proteome and whole proteome; and the dataset can be analyzed by the AI based REFS™ system.

In this example, epatocellular carcinoma (HCC) was selected to provide an illustrative implementation of the platform technology. HCC is one of the leading causes of cancer-related death worldwide, ranked as the third most fatal cancer after lung and stomach carcinomas. The diverse etiology, high morbidity/mortality, lack of diagnostic markers for early diagnosis and the highly variable clinical course of HCC have hindered advances in diagnosis and treatment. After years of studying the HCC, the understanding of molecular mechanism operational in HCC remains incomplete. The genomic, transcriptomic, and comparative proteomic profiles have yielded some important insights for HCC research. However, many studies focused on single aspect of the cellular changes associated with HCC, hindering the full understanding of biological systems in their true complexity and dynamics.

This illustrative example combines the power of (i) cell biology, (ii) integrated proteomics platforms and an informatics platform that generates causal protein networks to delineate the role of post-translation modification, e.g., phosphorylation, and enzymes that participate in such mechanisms, e.g., kinases, in the pathophysiology of HCC. In particular, this approach incorporates activity based proteomics employing ATP binding domain enrichment probes and phospho-proteome mapping of total proteins in HCC cellular models.

Multikinase inhibitor Sorafenib, a first line chemotherapeutic agent for the advanced HCC patients, was used to probe the role of global kinase activity and protein phosphorylation changes associated with this treatment. The HepG2 (ATCC Ascension No. HB-8065) cell line was selected to model HCC cells and the THLE2 (ATCC Ascension No. CRL-10149) cell line was selected to model normal hepatic cells.

Figure 41B:
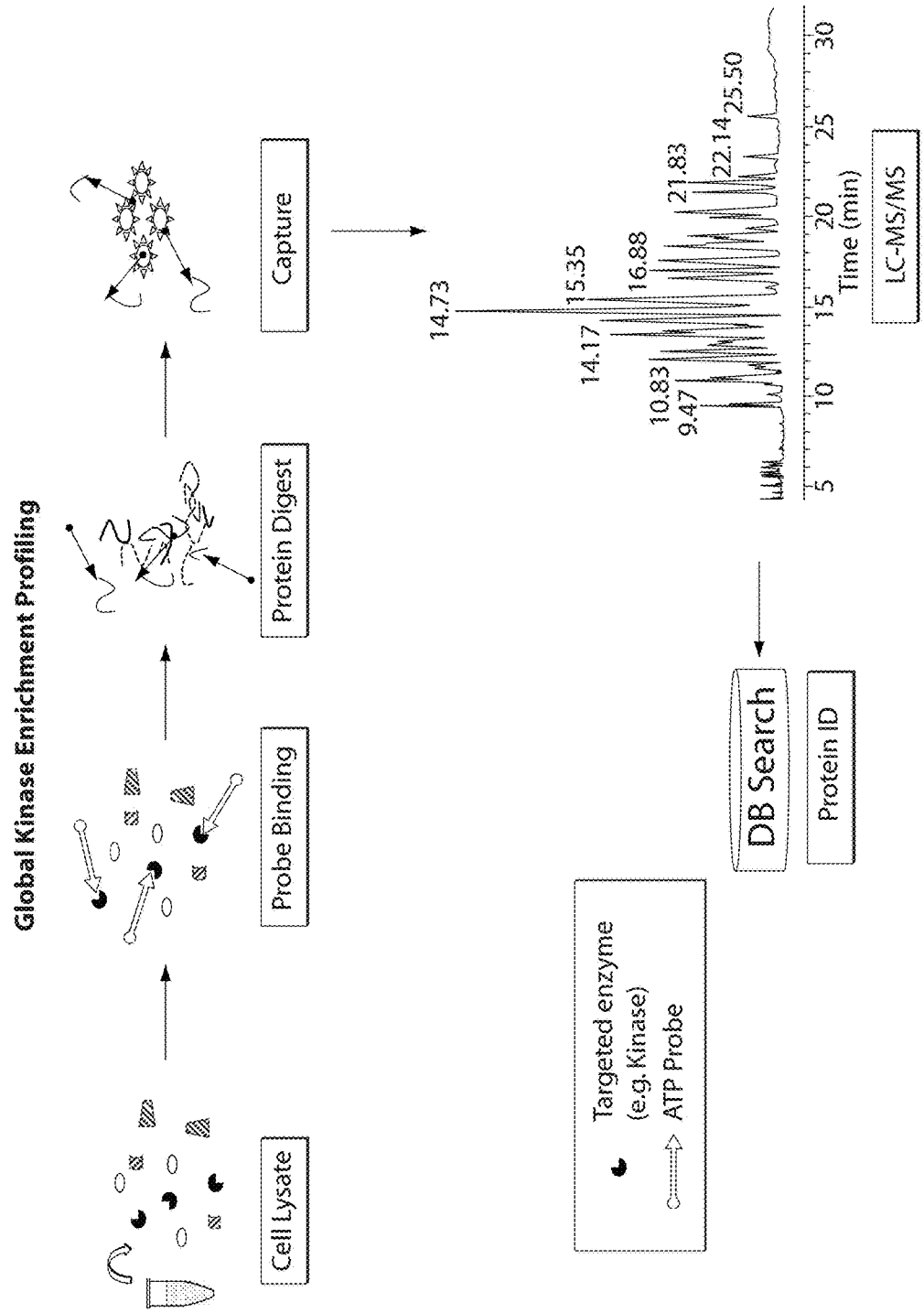

FIG. 41B illustrates a method for global enzyme (e.g., kinase) enrichment profiling. First, a cell lysate including the targeted enzyme (e.g., kinase) is prepared. The second step is probe binding (e.g., an ATP probe in the case of kinase). Then the enzyme is digested and probe-bound fragments are captured. These fragments can be analyzed (e.g., by LC-MS/MS) and the corresponding protein thus identified (e.g., via a database search of the LC-Ms/MS data).

THERMO SCIENTIFIC© PIERCE® Kinase Enrichment Kits and ACTIVX© probes (instructions available from THERMO SCIENTIFIC© and PIERCE® Biotechnology www.thermoscientific.com/pierce) were used for global enzyme activity analysis. Briefly, these and similar kits enable selective labeling and enrichment of ATPases including kinases, chaperones and metabolic enzymes. ATP and ADP Probes are generally nucleotide derivatives, which covalently modify the active site of enzymes with conserved lysine residues in the nucleotide-binding site. For example, the structure of desthiobiotin-ATP and -ADP consists of a modified biotin attached to the nucleotide by a labile acyl-phosphate bond. Depending on the position of the lysine within the enzyme active site, either desthiobiotin-ATP or -ADP can be preferred for labeling specific ATPases.

Both desthiobiotin-ATP and -ADP can selectively enrich, identify and profile target enzyme classes in samples or assess the specificity and affinity of enzyme inhibitors. Many ATPases and other nucleotide-binding proteins bind nucleotides or inhibitors even when they are enzymatically inactive; these reagents bind both inactive and active enzymes in a complex sample. Preincubation of samples with small-molecule inhibitors that compete for active-site probes can be used to determine inhibitor binding affinity and target specificity.

Assessment of active-site labeling can be accomplished by either Western blot or mass spectrometry (MS). For the Western blot workflow, desthiobiotin-labeled proteins are enriched for SDS-PAGE analysis and subsequent detection with specific antibodies. For the MS workflow, desthiobiotin-labeled proteins are reduced, alkylated and enzymatically digested to peptides. Only the desthiobiotin-labeled, active-site peptides are enriched for analysis by LC-MS/MS. Both workflows can be used for determining inhibitor target binding, but only the MS workflow can identify global inhibitor targets and off-targets.

THERMO SCIENTIFIC© PIERCE® $TiO_2$ Phosphopeptide Enrichment and Clean-up Kit (instructions available from THERMO SCIENTIFIC© and PIERCE® Biotechnology www dot thermoscientific dot com/pierce) were used for the phospho proteome analysis. Briefly, these and similar kits can enable efficient isolation of phosphorylated peptides from complex and fractionated protein digests for analysis by mass spectrometry (MS). Spherical porous titanium dioxide (TiO2) combined with optimized buffers provide enhanced enrichment and identification of phosphopeptides with minimal nonspecific binding. The spin-column format is fast and easy to use and can enrich up to 100 µg of phosphopeptides from 300-1000 µg of digested protein sample. The kit's optimized protocol, buffer components and graphite spin columns result in a high yield of clean phosphopeptide samples ready for MS analysis.

Phosphorylation is a protein modification essential to biological functions such as cell signaling, growth, differentiation and division, and programmed cell death. However, phosphopeptides have high hydrophilicity and are low in abundance, resulting in poor chromatography, ionization and fragmentation. Phosphopeptide enrichment is therefore essential to successful MS analysis. Phosphopeptide enrichment and clean-up kit can be compatible with lysis, reduction, alkylation, digestion and graphite spin columns to provide a complete workflow for phosphopeptide enrichment and identification.

Comparative proteomics, phospho proteome and enzyme activity data are integrated into the AI based REFS™ informatics platform. Causal networks of protein interaction specifically from a functional stand point namely kinase/enzyme activity and potential targets that kinases can phosphorylate are then generated. In addition, using cellular functional read out, enzymes/kinases that modulate phosphorylation of targets and mechanistically drive pathophysiological cellular behavior are determined. The illustrative implementation outlined herein facilitates global characterization of cellular responses, insights into mechanisms of chemo sensitivity and potential targets/biomarkers for clinical management of HCC.

Materials and Methods

The cells were cultured according to the following protocol. Day 1: HepG2/Hep3B—seed $3.2 \times 10^6$ cells in T-75 culture flasks; $7.4 \times 10^6$ cells in T-175 culture flasks; or $9.5 \times 10^6$ cells in T-225 culture flasks. THLE-2—seed $1.3 \times 10^6$ cells in T-75 culture flasks. Day 2: 16-24 hours later, at 50-70% confluence—add treatment. Control: DMSO at final concentration of 0.01%. EGF: 500 ng/mL in 10 mM acetic acid. Sorafenib: 1 µM at 0.1% volume in DMSO. Day 3: 24 hours after treatment, harvest cells by trypsinization. Wash pellets 2× with PBS before freezing.

The global enzyme activity analysis was conducted according to the following protocol.

Cell Lysis:

Fresh-made Lysis buffer—5 M urea, 50 mM Tris-HCL pH 8.4, 0.1% SDS, 1% Protease Inhibitor Cocktail, 1% Phosphatase Inhibitor Cocktail 1) Pellet cells in 1.5-2 mL Eppendorf microtubes by centrifuging at 2000 g for 5 minutes and remove supernatant.
2) Wash cells by resuspending pellet in PBS. Repeat wash once more.

3) Add an appropriate amount of lysis buffer to each sample and vortex.
4) Incubate on ice for 10 minutes with periodic mixing
5) Sonicate each sample until lysis is complete
6) Centrifuge at top speed for 15 minutes
7) Transfer lysate (supernatant) to new tube
Lysis Buffer-Exchange:
Used Pierce's pre-made Reaction Buffer.
Reaction buffer—20 mM HEPES pH 7.4, 150 mM NaCl, 0.1% TritonX-100
1) Twist off Zeba Spin Desalting Column's bottom closure and loosen cap
2) Put in 15 mL conical tube
3) Centrifuge column at room temperature at 1000 g for 2 minutes to remove storage solution
4) Add 3 mL of Reaction Buffer to column Centrifuge at 1000 g for 2 minutes to remove buffer. Repeat 2 more times, discarding buffer
   a. Centrifuge additional 1000 g for 2-3 minutes if there is excess buffer on last wash
5) Transfer column to new conical tube
6) SLOWLY apply entire lysate to center of resin bed
7) Centrifuge at 1000 g for 2 minutes to collect sample. Discard column
8) Add 1:100 protease/phosphatase inhibitor cocktail to sample and place on ice
   a. Samples may be frozen in −80° C. freezer
Stopping point
Sample Labeling with Probe:
Used pre-made 1 M $MgCl_2$ from Pierce.
Made fresh 1 M $MnCl_2$.
1) Determine protein concentration using Bradford Assay
2) Dilute lysate with water to 2 mg/mL (2 µg/µL) if possible
3) Transfer 2 mg to new microcentrifuge tube
4) Add 20 µL of 1 M $MgCl_2$ to each sample, mix, incubate for 1 min at room temperature.
Note: Final concentration is 0.02 M $MgCl_2$
5) Add 10 µL of 1 M $MgCl_2$ to each sample, mix, incubate for 1 min at room temperature
Note: Final concentration is 10 mM $MgCl_2$.
6) Equilibrate ATP/ADP reagent to room temperature with desiccant. Store remainder at −80° C.
7) For 20 µM reaction—add 10 µL of ultrapure water to reagent to make 1 mM stock solution
8) Add 20 µL of ATP/ADP stock to each sample and incubate for 1 hour at room temperature.
Labeled Protein Reduction and Alkylation:
Prepare fresh 10 M Urea/50 mM Tris-HCL pH 8.4
1) Add 1 mL of 10 M Urea/50 mM Tris-HCL to each reaction
2) Add 100 µL of 200 mM TCEP to each sample. Incubate at 55° C. for 1 hr
3) Add 100 µL of 375 mM iodoacetamide to each sample. Incubate at room temperature for 30 minutes in the dark
Buffer Exchange:
Prepare fresh Digest Buffer—2 M urea, 200 mM Tris-HCL pH 8.4
1) Twist off Zeba Spin Desalting Column's bottom closure and loosen cap
2) Put in 15 mL conical tube
3) Centrifuge column at room temperature at 1000 g for 2 minutes to remove storage solution
4) Add 3 mL of Digest Buffer to column. Centrifuge at 1000 g for 2 minutes to remove buffer. Repeat 2 more times, discarding buffer
   a. Centrifuge additional 1000 g for 2-3 minutes if there is excess buffer on last wash
5) Transfer column to new conical tube
6) SLOWLY apply entire sample to center of resin bed
7) Centrifuge at 1000 g for 2 minutes to collect sample. Discard column
Labeled Protein Digest:
1) Add trypsin in 1:50 ratio (trypsin:protein)
2) Incubate at 37° C. with shaking for overnight
Labeled Peptide Capture and Elution:
Prepare fresh Elution Buffer (50% ACN; 0.1% formic acid)
1) Add 50 µL of slurry to each digested sample. Incubate for 1.5 hours at room temperature with constant mixing
2) Transfer sample to Pierce Spin column Centrifuge at 1000 g for 1 minute. Collect flow-through and save.
3) At 1000 g for 1 minute per wash:
   a. Wash resin 3× with 500 µL of 4 M urea/50 mM Tris-HCl pH 8.4
   b. Wash resin 4× with 500 µL of PBS
   c. Wash resin 4× with 500 µL of water
4) Elute peptides with 75 µL of Elution Buffer and incubate for 3 minutes. Repeat 2 more times, combining eluate fractions
5) Lyophilize samples in vacuum concentrator.
Label-free, 1-D separation for LCMSMS analysis
1) Once samples are dried by lyophilizing, resuspend each sample in 25 µL of 0.1% formic acid
2) Transfer 10 µL into vials for LCMSMS
iTRAQ Labeling
1) The remaining 15 µL samples were dried completely
2) Resuspend samples in 30 µL of 200 mM TEAB
3) 15 µL of sample was labeled with 30 µL of iTRAQ reagent and incubated for 2 hours at room temperature
   a. 6 µL per sample was pooled for the QCP
4) After labeling, 8 µL of 5% hydroxamine was added for quenching for 15 minutes at 4° C.
5) All MP's were pooled together, dried, desalted, and resuspended in 20 µL of 0.1% formic acid.
Eksigent/LTQ Orbitrap instrument was having problems so MP's were dried and resuspended in 18 µL of 20 mM ammonium formate.
Leftovers per sample:
9 µL of eluate in 200 mM TEAB in −80° C.
MP's in 20 mM ammonium formate on instrument
The phospho protein analysis was conducted according to the following protocol.
Sample Prep Protocol:
1. Cell lysis
   a. Lysis buffer—5 M urea, 50 mM Tris-HCL, 0.1% SDS, 1% Protease Inhibitor Cocktail, 1% Phosphatase Inhibitor Cocktail
   b. Suspend pellet in the appropriate amount of lysis buffer
   c. Vortex and incubate for 10 minutes on ice. Repeat.
   d. Sonicate and incubate for 10 minutes on ice.
   e. Centrifuge at top speed for 15 minutes
   f. Resonicate if lysate is still viscous/sticky.
   g. Transfer lysate to new tube
2. Perform Bradford assay to determine protein concentration
3. Transfer 700 µg of protein (400 µg for THLE-2) to new microtube with 45 µL of 200 mM TEAB
4. Reduced with 200 mM TCEP at 5 µL TCEP: 100 µL volume for 1 hour at 55° C.

5. Alkylate with 375 mM iodoacetamide at 5 µL iodo:100 µL volume at room temperature for 30 minutes in the dark
6. Acetone precipitation at 7× the volume overnight in −20° C.
7. Resuspend protein in 200 mM TEAB at 50 µg/µL. Digest with trypsin at 1:40 (trypsin:protein) at 37° C. overnight During column preparation, resuspend peptide sample in 150 µL of Buffer B.

Column Preparation:
1. Place Centrifuge Column Adaptor in collection tube and insert $TiO_2$ Spin Tip into adaptor.
2. Add 20 µL of Buffer A. Centrifuge at 3000 g for 2 minutes. Discard FT.
3. Add 20 µL of Buffer B. Centrifuge at 3000 g for 2 minutes. Discard FT.

Phosphopeptide Binding:
1. Transfer spin tip to a clean microtube.
2. Apply suspended sample to spin tip. Centrifuge at 1000 g for 10 minutes
3. Reapply sample to spin tip and centrifuge 1000 g for 10 minutes. Save FT.
4. Transfer spin tip to a new microtube.
5. Wash column by adding 20 µL of Buffer B. Centrifuge at 3000 g for 2 minutes.
6. Wash column by adding 20 µL of Buffer A. Centrifuge at 3000 g for 2 minutes. Repeat once more.

Elution:
1. Place spin tip in new collection tube. Add 50 µL of Elution Buffer 1. Centrifuge at 1000 g for 5 minutes
2. Using same collection tube, add 50 µL of Elution Buffer 2 to spin tip. Centrifuge for 1000 g for 5 minutes
3. Acidify elution fraction by adding 100 µL of 2.5% Formic Acid.

Graphite Clean-up of Phosphopeptides
**Replace TFA with Formic Acid since this is the final clean-up before LC/MS/MS analysis Column Preparation:
1. Remove top and bottom cap from graphite spin column. Place column in 1.5 mL microtube. Centrifuge at 2000 g for 1 minute to remove storage buffer.
2. Add 100 µL of 1 M $NH_4OH$. Centrifuge at 2000 g for 1 minute. Discard FT. Repeat once more.
3. Activate graphite by adding 100 µL of acetonitrile. Centrifuge at 2000 g for 1 minute. Discard FT.
4. Add 100 µL of 1% Formic Acid. Centrifuge at 2000 g for 1 minute. Discard FT. Repeat once more.

Sample Binding and Elution:
Elution=0.1% FA+50% ACN
1. Place column into new collection tube. Apply sample on top of resin bed. Allow binding for 10 minutes with periodic vortex mixing
2. Centrifuge at 1000 g for 3 minutes. Discard FT.
3. Place column into new collection tube. Wash column by adding 200 µL of 1% FA. Centrifuge at 2000 g for 1 minute. Discard FT. Repeat once more.
4. Place column into new collection tube. Add 100 µL of 0.1% FA/50% ACN to elute sample. Centrifuge at 2000 g for 1 minute. Repeat 3 more times for total elution of 400 µL.
5. Dry samples in vacuum evaporator (SpeedVac)

HepG2 and Hep3B:
Start with 700 µg of protein
After $TiO_2$ enrichment and graphite clean-up, phosphopeptides were eluted in 400 µL of 0.1% formic acid/50% ACN.
A ratio of (400/700)*400 µL aliquot was taken from eluent and dried completely. It was resuspended in 20 µL of 200 mM TEAB for iTRAQ labeling.
After labeling, samples were desalted, dried, and resuspended in 20 µL of 0.1% formic acid.
Remaining aliquot was dried completely and resuspended in 20 µL of 0.1% formic acid.
10 µL was transferred to vials for label-free LCMSMS analysis.

THLE-2:
Only 400 µg of protein was harvested.
All of the protein was enriched with $TiO_2$ columns and cleaned with graphite columns
The elutes were dried, resuspended in 20 µL of 200 mM TEAB for iTRAQ labeling
After labeling, samples were desalted, dried, and resuspended in 20 µL of 0.1% formic acid.

Figure 42:
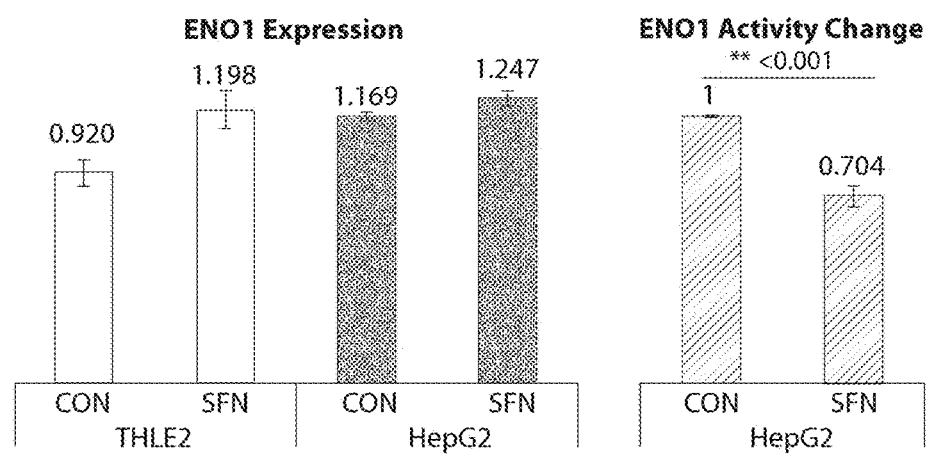
FIG. 42 illustrates a significant decrease in ENO1 activity not protein expression in HepG2 treated with Sorafenib.
Figure 43:
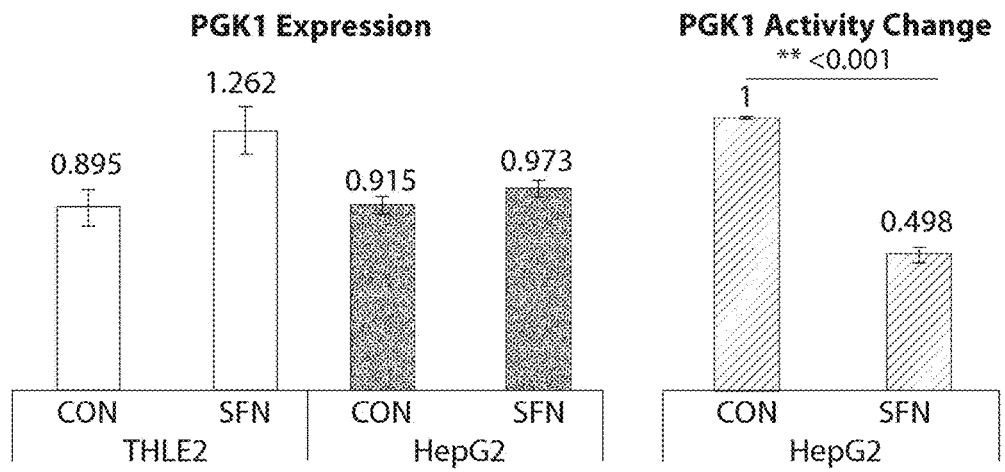
FIG. 43 illustrates a significant decrease in PGK1 activity and not protein expression in HepG2 treated with Sorafenib.
Figure 44:
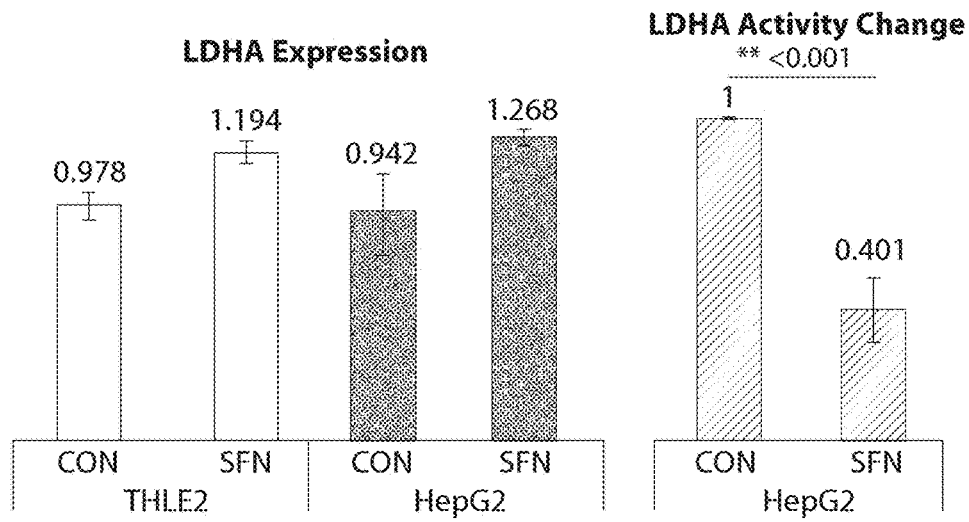
FIG. 44 illustrates a Significant decrease in LDHA activity in HepG2 treated with Sorafenib.

Leftover samples:
iTRAQ samples—on instrument in 20 mM ammonium formate
Label-free HepG2/Hep3B—10 µL in 0.1% formic acid in −80° C.; 10 µL in 0.1% formic acid on instrument Results FIG. 42 illustrates a significant decrease in ENO1 activity but not ENO1 expression in HepG2 treated with Sorafenib. FIG. 43 illustrates a significant decrease in PGK1 activity but not in PGK1 protein expression in HepG2 treated with Sorafenib. FIG. 44 illustrates a significant decrease in LDHA activity in HepG2 treated with Sorafenib. In each case, ENO1 expression was measured in units relative to a QC sample and the ENO1 activity change was measured in units relative to the control, untreated sample.

The data in FIGS. 42-44 show that for ENO1, LDHA, and PGK1 in the HCC disease model, treatment of cells with Sorafenib results in upregulation of protein expression while concomitantly downregulating the protein's enzymatic activity. Thus, the phospho proteome affords an additional layer of information that can be used for elucidating the complex relationship between the effect of an extracellular signal (e.g., drug molecule) on kinase activity and total cellular protein, thereby facilitating the identification of disease treatment targets, as well as diagnostic/prognostic markers associated with disease.

Figure 45:
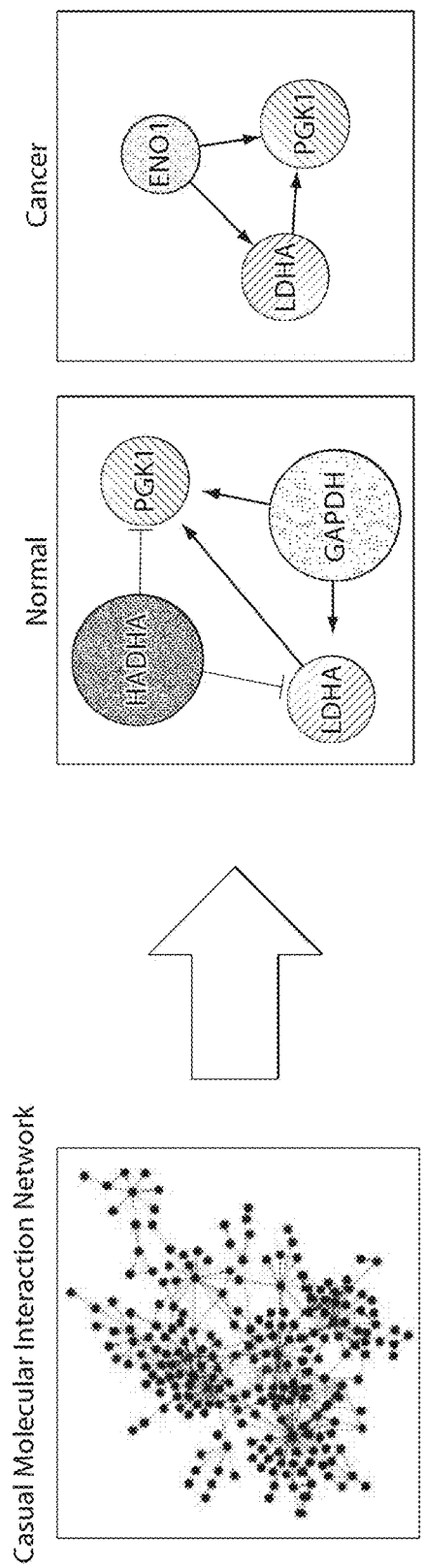
FIG. 45 illustrates a causal molecular interaction network that can be produced by analyzing the dataset using the AI based REFS™ system.

FIG. 45 illustrates (see left frame) a causal molecular interaction network that can be produced by analyzing a resulting dataset using the AI based REFS™ system. The network can be used, for example, to identify networks of interest that are differentially regulated in normal and cancer cells (see middle and right frames, respectively). Such information can be used to provide HCC treatment targets, as well as diagnostic/prognostic markers associated with HCC.

FIGS. 46-51 illustrate how a two dimensional chemical interrogation of oncogenic systems and multi-omics integration of signatures can reveal novel signaling pathways involved in the pathophysiology of cancer, thereby identifying therapeutic targets, relevant biomarkers, and/or therapeutics. In particular, FIGS. 46-51 illustrate the implementation of the general methodology shown in FIG. 41 and in accordance with the various methods described herein. As shown in FIG. 41, the approach is powered by "two dimensional chemical interrogation" where in vitro cancer and control models were interrogated by a kinase inhibitor (Sorafenib) in a first dimension. Overall changes in kinase activity were captured by a second dimension of chemical interrogation employing activity based kinase enrichment probes. Kinases were identified by LC-MS. In addition, changes in the phospho proteome in response to exposure to the kinase inhibitor were captured using a phospho protein enrichment method followed by LC-MS for identification of proteins. Finally, quantitative changes in total protein expression were obtained. The resulting multi-omics data was integrated using AI-based informatics, leading to the generation of data-driven causal networks representing differential kinase activity driving phosphorylation of proteins that are operational in a cancer model but not in a "normal" model. Integration of these complementary analysis is shown in the inferred pathways of FIGS. 46 and 47. The technology led to the discovery of novel kinases and relationships that are mechanistically relevant to pathophysiology of cancer (e.g., FIGS. 48-50).

Figure 46:
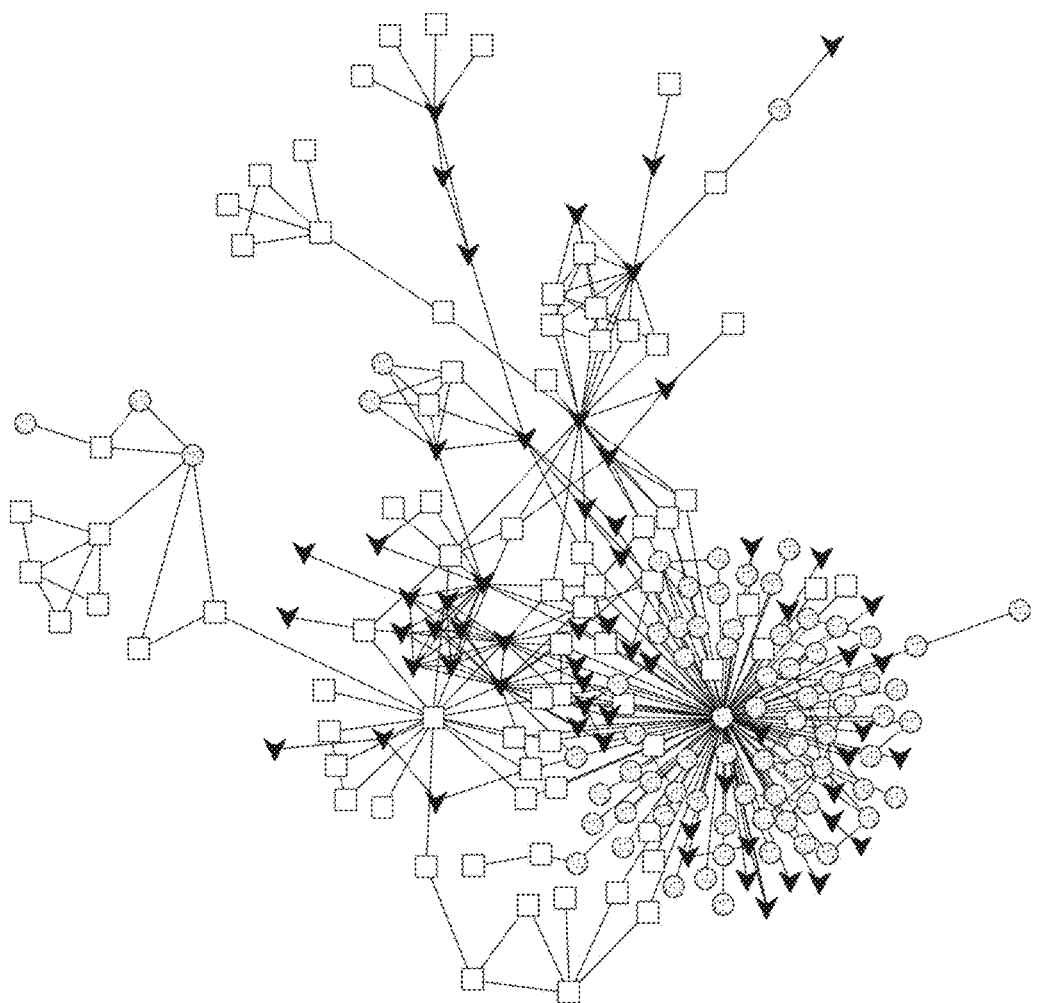
FIG. 46 illustrates how integration of multiomics data employing bayesian network inference algorithms can lead to improved understanding of signaling pathways in hepatocellular carcinoma. Yellow squares represent post transcriptional modification (Phospho) data, blue triangles represent activity based (Kinase) data, and green circles represent proteomics data.
Figure 47:
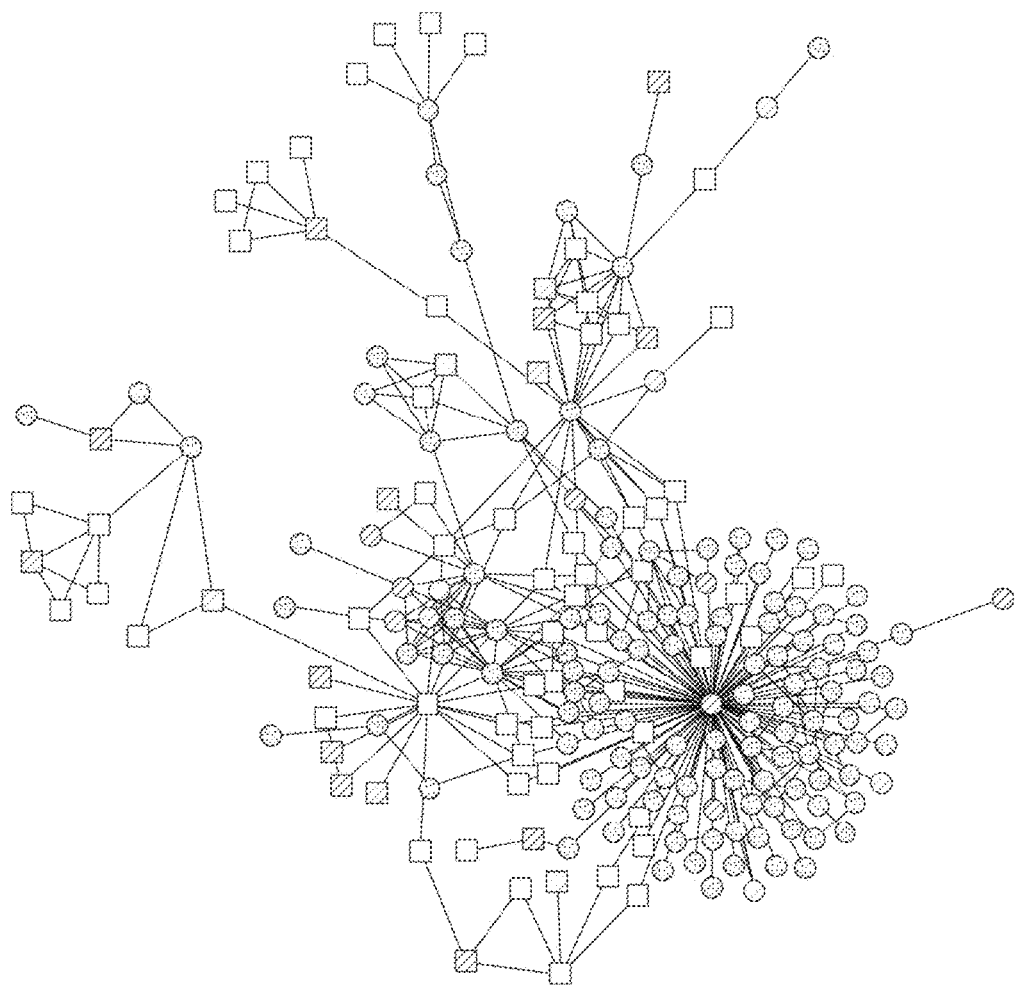
FIG. 47 illustrates how autoregulation and reverse feed back regulation in hepatocellular carcinoma signaling pathways can be inferred by the Platform. Squares represent post transcriptional modification (Phospho) data (grey/dark=Kinase, yellow/light—No Kinase Activity), squares represent activity based (Kinase)+Proteomics data (grey/dark=Kinase, yellow/light—No Kinase Activity).

FIG. 46 illustrates how the integration of multiomics data employing bayesian network inference algorithms can lead to improved understanding of signaling pathways in hepatocellular carcinoma. Yellow squares represent post transcriptional modification (Phospho) data, blue triangles represent activity based (Kinase) data, and green circles represent proteomics data. FIG. 47 illustrates how autoregulation and reverse feed back regulation in hepatocellular carcinoma signaling pathways can be inferred by the Platform. Squares represent PMT (Phospho) data (grey/dark=Kinase, yellow/light–No Kinase Activity), squares represent activity based (Kinase)+Proteomics data (grey/dark=Kinase, yellow/light–No Kinase Activity). These analyses were carried our using the three-layered multi-proteomics methodology described above and summarized in FIG. 41. Results of these analyses are shown in FIGS. 48-51 and discussed in further detail below.

Figure 48:
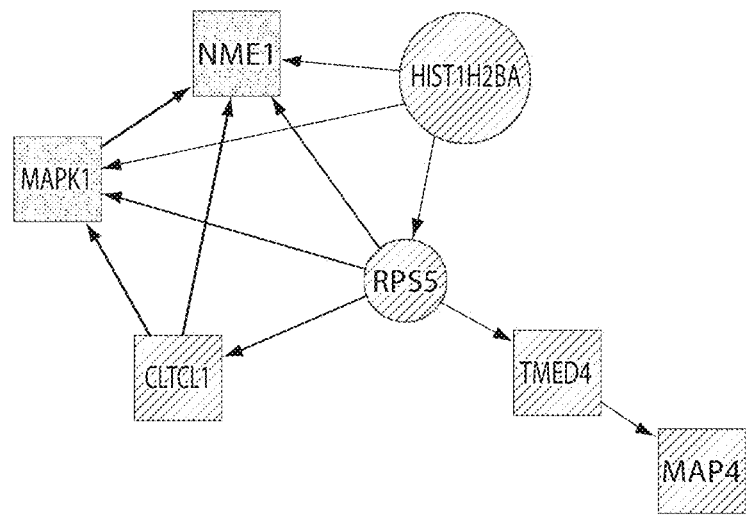
FIGS. 48-51 illustrate examples of causal association in signaling pathways inferred by the Platform. Kinase isoforms are indicated on representative squares and circles, with causal associations indicated by connectors.
Figure 49:
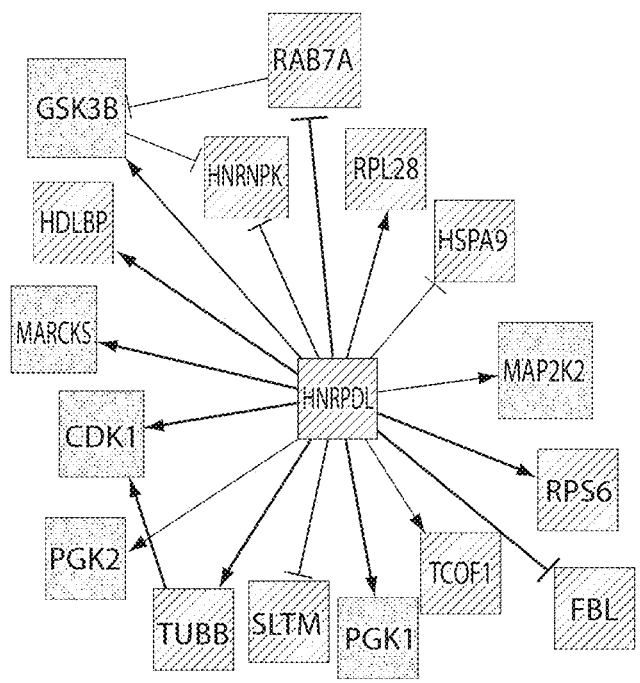
Figure 50:
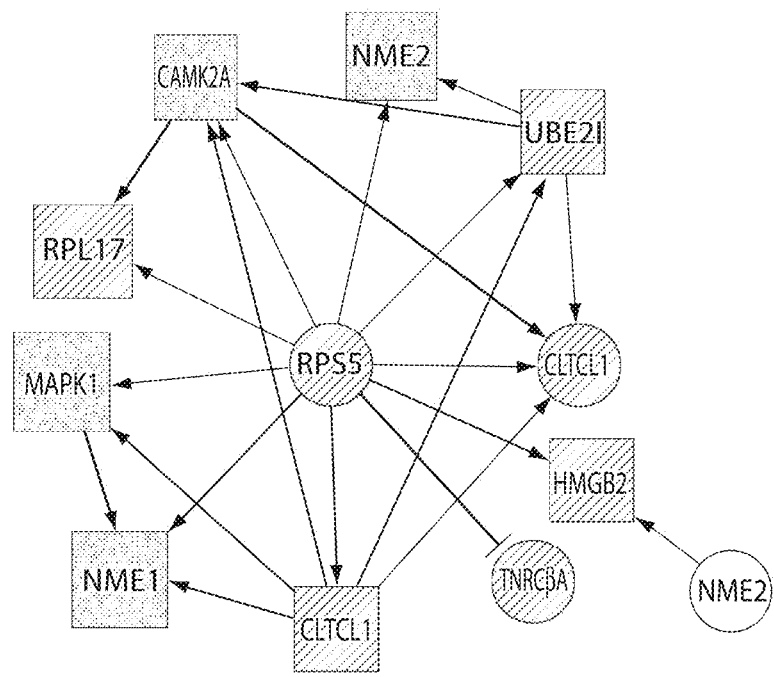

FIGS. 48-50 illustrate examples of causal association in signaling pathways inferred by the Platform. Kinase names are indicated on representative squares and circles, with causal associates indicated by connectors. FIG. 48 identifies the CLTCL1, MAPK1, NME1, HIST1H2BA, RPS5, TMED4, and MAP4 kinase isoforms and shows an inferred relationship therebetween. FIG. 49 identifies the HNRPDL, HNRNPK, RAB7A, RPL28, HSPA9, MAP2K2, RPS6, FBL, TCOF1, PGK1, SLTM, TUBB, PGK2, CDK1, MARCKS, HDLBP, and GSK3B kinase isoforms and shows an inferred relationship therebetween. FIG. 50 identifies the RPS5, TNRCBA, CLTCL1, NME1, MAPK1, RPL17, CAMK2A, NME2, UBE21, CLTCL1, HMGB2, and NME2 kinase isoforms and shows an inferred relationship therebetween. These kinase isoforms present potential therapeutic targets, markers, and therapeutics.

Figure 51:
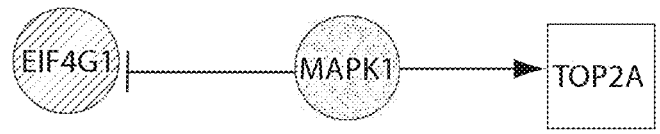

FIG. 51 illustrates a causal association derived by the Platform. In particular, FIG. 51 identifies the EIF4G1, MAPK1, and TOP2A kinase isoforms and shows an inferred relationship therebetween. This relationship provides validation for the model and method because it comports with the published relationship between EIF, MAPK, and TOP kinases.

In conclusion, multiomics based analysis of enzyme (e.g., kinase) activity represents a useful method for the determination of downstream causal relationships between metabolites and substrates as a function of cell behavior. Likewise, activity based proteome monitoring of changes in global enzyme activity in response to therapeutic treatment can provide critical insight into cellular signaling dynamics as compared to monitoring only the overall cellular expression of proteins (e.g., enzymes). Furthermore, it has been shown that the Platform can robustly infer signaling pathways and reverse feed back regulation in oncogenic versus normal environments and, therefore, identify novel causal associations in oncogenic signaling pathways. Accordingly, the technology provides identification of novel kinases and deciphering mechanism of action of kinase inhibitors.

Example 6: In Vitro Model of Angiogenesis and Modulation by CoQ10

Introduction:

Progression of tumor size greater than 2-5 mm in size requires induction of angiogenesis to supply the tumor with oxygen and nutrients. Angiogenesis occurs due to intratumoral cell release of endothelial mitogenic factors in response to hypoxia or genetic mutation, and there are currently numerous endogenous proteins in clinical development as therapeutic antiangiogenesis targets e.g. VEGF and P1GF. Herein, we have investigated Coenzyme Q10 (CoQ10) in vitro, which is currently under investigation in human studies of cancer progression.

Methods:

Human umbilical vein endothelial cell (HUVEC) fate decisions that modulate the angiogenic phenotype were examined in the presence of 100 or 1500 μM CoQ10 or excipient and compared to untreated control cells. Endothelial cell fate assays for apoptosis, proliferation, migration and 3-D tube formation within MATRIGEL® were performed.

Results:

Morphological and flow cytometric analysis of annexin V/propidium iodide positive cells revealed an increase in HUVEC apoptosis in the presence of 1500 μM CoQ10, compared to excipient or control cells. Concomitant with increased cell death due to CoQ10, HUVEC cell counts were significantly decreased in the presence of 1500 μM CoQ10. To assess the potential effects of CoQ10 on endothelial migration, HUVEC migration was examined 5 hours postcell clearance, in an endothelial scratch assay. Both CoQ10 and excipient significantly impaired HUVEC migration at both 100 and 1500 μM concentration, demonstrating antimigratory activity of both the excipient and CoQ10. In order to determine if the CoQ10 anti-tumor activity is due to effects on endothelial sprouting angiogenesis, we examined endothelial tube formation in 3-D MATRIGEL® cultures over time. Addition of excipient in both the gel and overlying media impaired tube formation compared to control. Moreover, addition of 1500 μM CoQ10 further impaired HUVEC tube formation compared to both excipient and control untreated cells. These effects were noted as early as 24 hours after seeding and up to 96 hours in culture. Taken together, these studies demonstrate that CoQ10 effect is likely, at least in part, due to inhibition of tumor recruitment of local blood supply for neo-vessel formation.

Figure 52A:
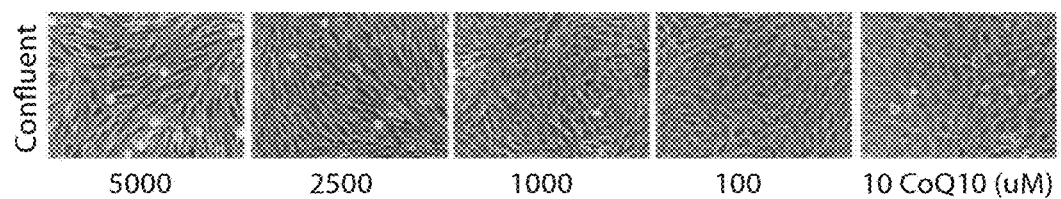
FIGS. 52A-B show human umbilical vein endothelial cells (HUVECs) grown in (A) confluent or (B) subconfluent cultures were treated for 24 hours with a range of concentrations of CoQ10 as indicated. Confluent cells closely resemble 'normal' cells whereas to sub-confluent cells more closely represent the angiogenic phenotype of proliferating cells. In confluent cultures, addition of increasing concentrations of CoQ10 led to closer association, elongation and alignment of ECs. 5000 μM led to a subtle increase in rounded cells.
Figure 52B:
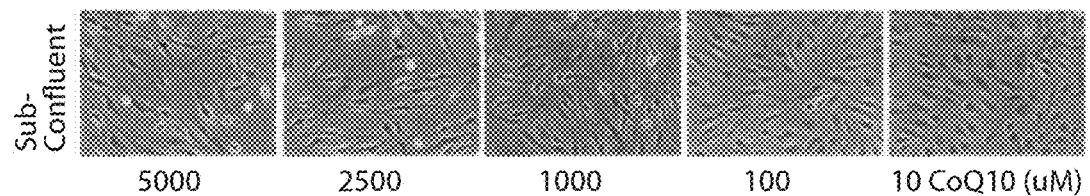

Effect of CoQ10 on Endothelial Morphology:

Human umbilical vein endothelial cells (HUVEC cells) were treated for 24 hours with a range of concentrations of CoQ10. Drug was applied to confluent cells that closely resemble 'normal' cells and also to sub-confluent cells that more closely represent the angiogenic phenotype of proliferating cells. In confluent cultures, addition of increasing concentrations of CoQ10 led to closer association, elongation and alignment of ECs. 5000 μM led to a subtle increase in rounded cells (FIG. 52A). The response of sub-confluent endothelial cells to CoQ10 diverged from the confluent cell response (FIG. 52B). Endothelial were visibly unhealthy at 1000 μM CoQ10 and above. Increased cell death was visible with increasing concentrations of CoQ10.

Figure 53A:
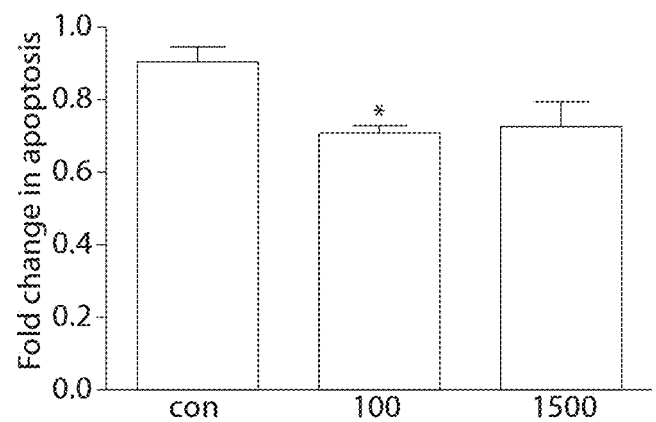
FIGS. 53A-C show confluent (A) and subconfluent (B) cultures of HUVEC cells were treated for 24 hours with 100 or 1500 μM CoQ10 and assayed for propidium iodide positive apoptotic cells. CoQ10 was protective to ECs treated at confluence, whereas sub-confluent cells were sensitive to CoQ10 and displayed increased apoptosis at 1500 μM CoQ10. (C) Representative histograms of sub-confluent control ECs (left), 100 μM CoQ10 (middle) and 1500 μM CoQ10 (right).
Figure 53B:
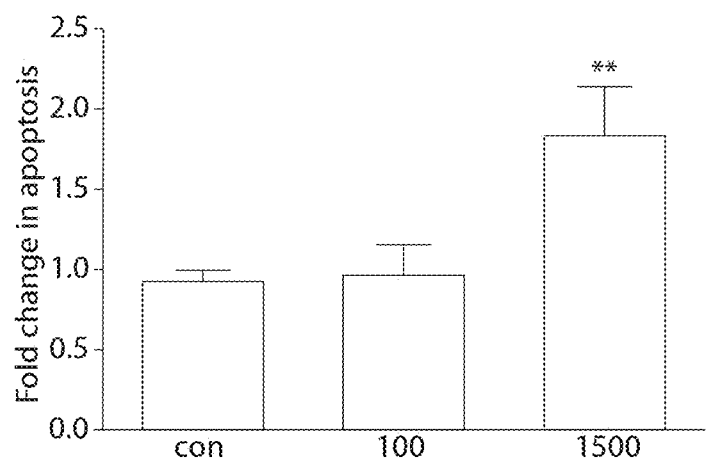
Figure 53C:
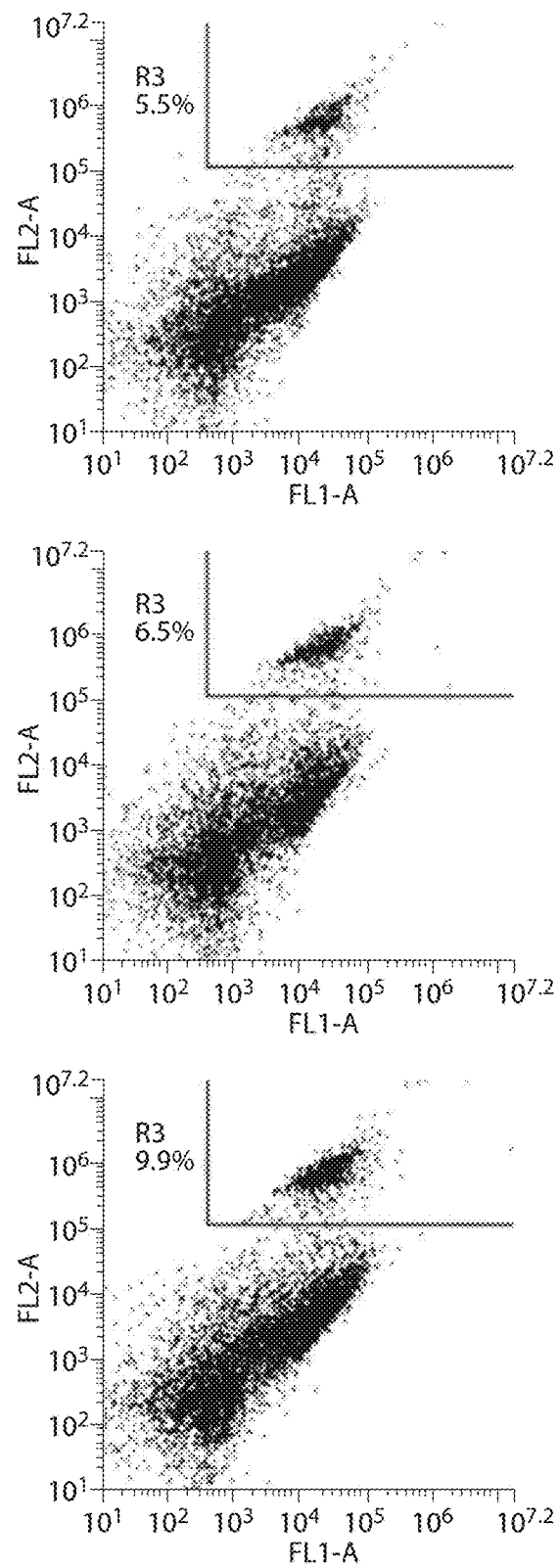

CoQ10 has Divergent Effects on Endothelial Cell Survival:

Confluent and sub-confluent cultures of HUVEC cells were treated for 24 hours with 100 or 1500 µM CoQ10 and assayed for propidium iodide positive apoptotic cells. The results are shown in FIGS. 53A and 53B, respectively. CoQ10 was protective to ECs treated at confluence, whereas sub-confluent cells were sensitive to CoQ10 and displayed increased apoptosis at 1500 µM CoQ10. Representative histograms of sub-confluent control ECs (left), 100 µM CoQ10 (middle) and 1500 µM CoQ10 (right) demonstrating increasing levels of apoptosis with increasing concentrations of CoQ10 are shown in FIG. 53C.

Figure 54A:
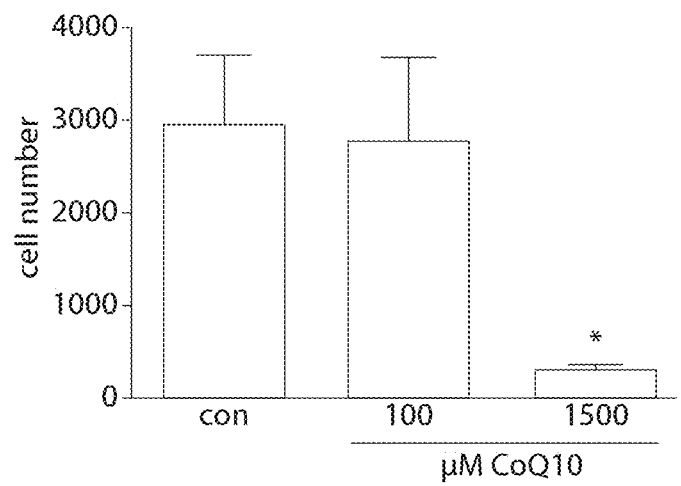
FIGS. 54A-C show subconfluent cultures of HUVEC cells were treated for 72 hours with 100 or 1500 μM CoQ10 and assayed for both cell numbers (A) and proliferation (B) using a propidium iodide incorporation assay (detects G2/M phase DNA). High concentrations of CoQ10 led to a significant decrease in cell numbers and had a dose-dependent effect on EC proliferation. Representative histograms of cell proliferation gating for cells in the G2/M phase of the cell cycle [control ECs (left), 100 μM CoQ10 (middle) and 1500 μM CoQ10 (right)] are shown in (C).
Figure 54B:
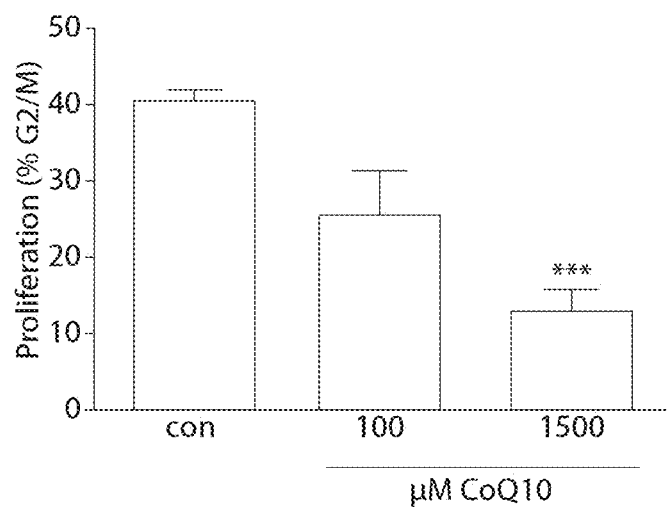
Figure 54C:
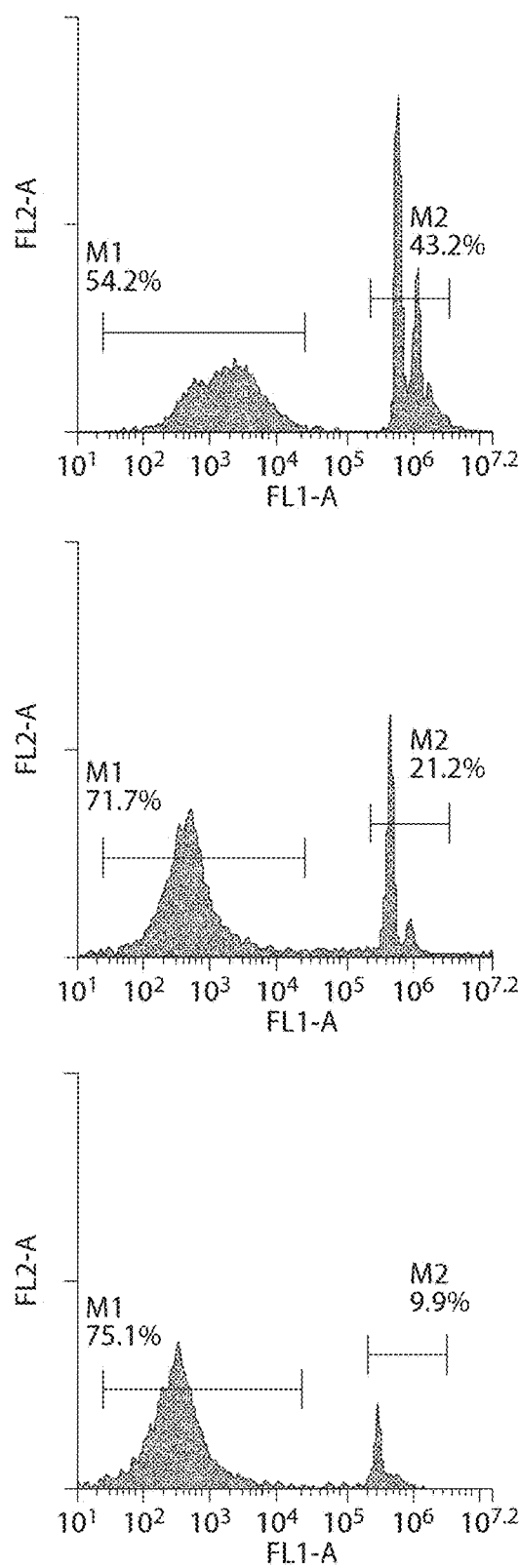

CoQ10 Decreases Endothelial Cell Numbers and Proliferation:

Sub-confluent cultures of HUVEC cells were treated for 72 hours with 100 or 1500 µM CoQ10 and assayed for both cell numbers (FIG. 54A) and proliferation (FIG. 54B) using a propidium iodide incorporation assay (detects G2/M phase DNA). High concentrations of CoQ10 led to a significant decrease in cell numbers and had a dose-dependent effect on EC proliferation. Representative histograms of cell proliferation gating for cells in the G2/M phase of the cell cycle demonstrating decreased cell proliferation with increasing concentrations of CoQ10 [FIG. 54C, control ECs (left), 100 µM CoQ10 (middle) and 1500 µM CoQ10 (right)].

Figure 55:
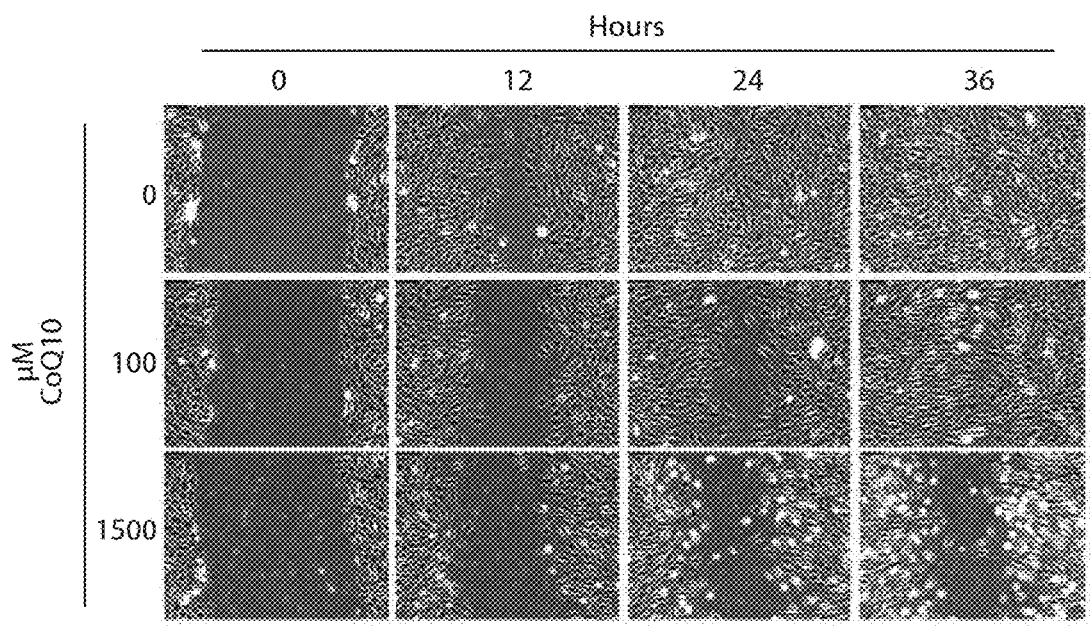
FIG. 55 shows HUVEC cells were grown to confluence tested for migration using the 'scratch' assay. 100 or 1500 μM CoQ10 was applied at the time of scratching and closure of the cleared area was monitored over 48 hours. 100 μM CoQ10 delayed endothelial closure compared to control. Addition of 1500 μM CoQ10 prevented closure, even up to 48 hours (data not shown).

CoQ10 Decreases Endothelial Cell Migration:

HUVEC cells were grown to confluence tested for migration using the 'scratch' assay. 100 or 1500 µM CoQ10 was applied at the time of scratching and closure of the cleared area was monitored over 48 hours. 100 µM CoQ10 delayed endothelial closure compared to control. Representative images at 0, 12, 24, and 36 hours are provided in FIG. 55. Addition of 1500 µM CoQ10 prevented closure, even up to 48 hours (data not shown).

Figure 56:
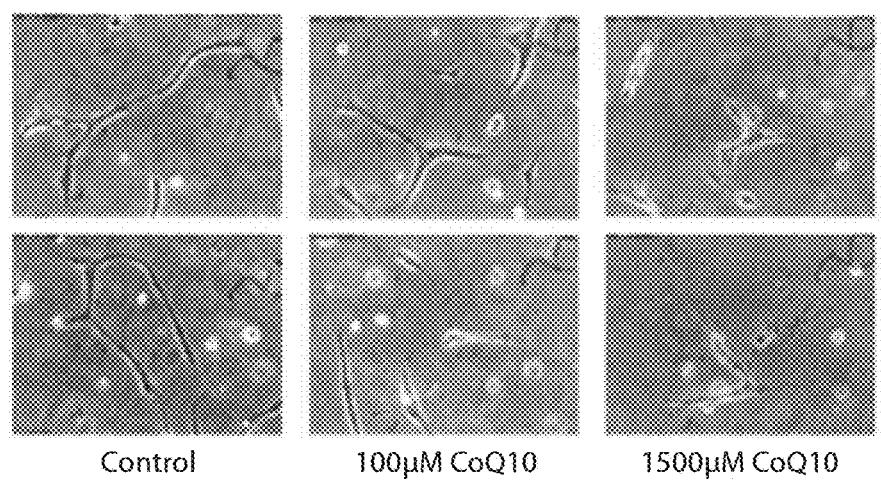
FIG. 56 shows endothelial cells growing in 3-D matrigel form tubes over time. Differential effects of 100 μM and 1500 μM CoQ10 on tube formation were observed. Impaired cell to cell association and breakdown of early tube structure was significant at 1500 μM CoQ10. Images shown were taken at 72 hours.

CoQ10 Impairs Endothelial Tube Formation:

Endothelial cells growing in 3-D matrigel form tubes over time. Differential effects of 100 µM and 1500 µM CoQ10 on tube formation were observed. Impaired cell to cell association and breakdown of early tube structure was significant at 1500 µM CoQ10. Interestingly, tube formation did commence in the presence of 1500 µM CoQ10, however the process was impaired 48 hours into tube growth and formation. Images shown in FIG. 56 were taken at 72 hours.

Results and Conclusion:

We investigated the potential angiogenesis modulating effects of CoQ10. CoQ10 is an anti-cancer agent currently under investigation in human solid tumor studies that modulates the cellular energy metabolism.

CoQ10 at low doses was protective to confluent endothelial cells, whereas addition of CoQ10 to sub-confluent cells led to increased apoptosis, decreased cell numbers and was a potent inhibitor of endothelial proliferation. We demonstrate divergent effects on confluent and subconfluent cells that would protect the 'normal' vasculature.

Functional assessment of the endothelial ability to migrate in 2-D scratch assays revealed a potent inhibition of endothelial migration. Time-lapse photography revealed a dynamic endothelial 'front' that fails to close the cleared zone over a 2 day culture/treatment.

Suspension of endothelial cells in 3-D matrigel leads to formation of tubes over time. Using this well-characterized assay that recapitulates many of the factors at play in tumor angiogenesis, we examined the effect of CoQ10 on endothelial tube formation. Addition of 100 µM CoQ10 had a modest effect of tube formation, however addition of 1500 µM CoQ10 led to a dramatic disruption of endothelial tube formation.

In summary, these results demonstrate the effect of CoQ10 on endothelial sprouting, migration and proliferation and selectively induces cell death in angiogenic endothelial cells.

Example 7: Coenzyme Q10 Differentially Modulated Functional Responses in Confluent and Subconfluent HUVEC Cells Having demonstrated a differential effect of CoQ10 on cell proliferation and migration in HUVEC cells grown under confluent and subconfluent conditions, the effects of CoQ10 on the biochemical pathways of HUVEC cells was investigated.

Figure 57A:
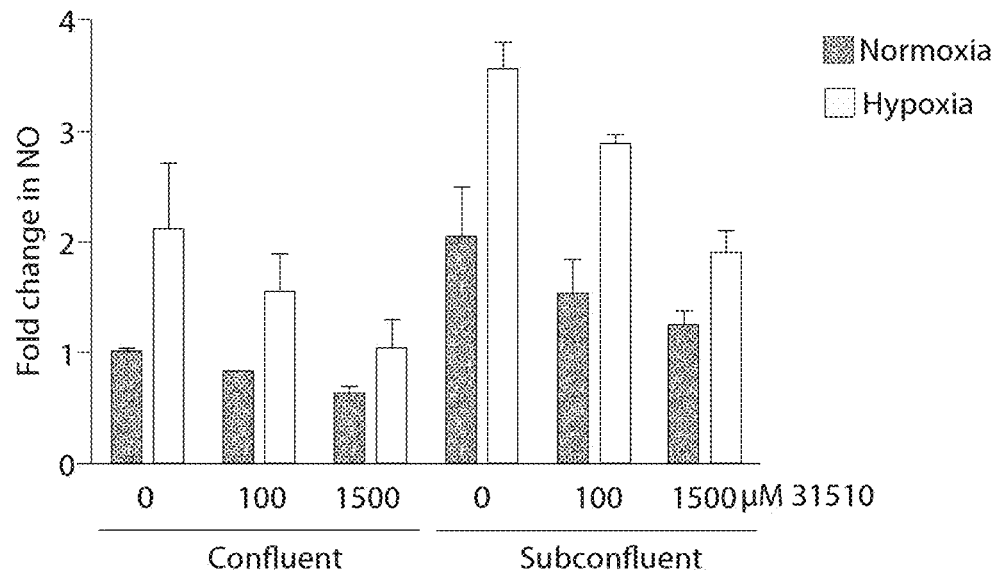
FIGS. 57A-B show endothelial cells were grown in sub-confluent and confluent cultures were grown in the presence or absence of CoQ10 under both normal and hypoxic conditions. Generation of nitric oxide (NO) (A) and reactive oxygen species (ROS) (B) in response to CoQ10 and hypoxia were assessed.
Figure 57B:
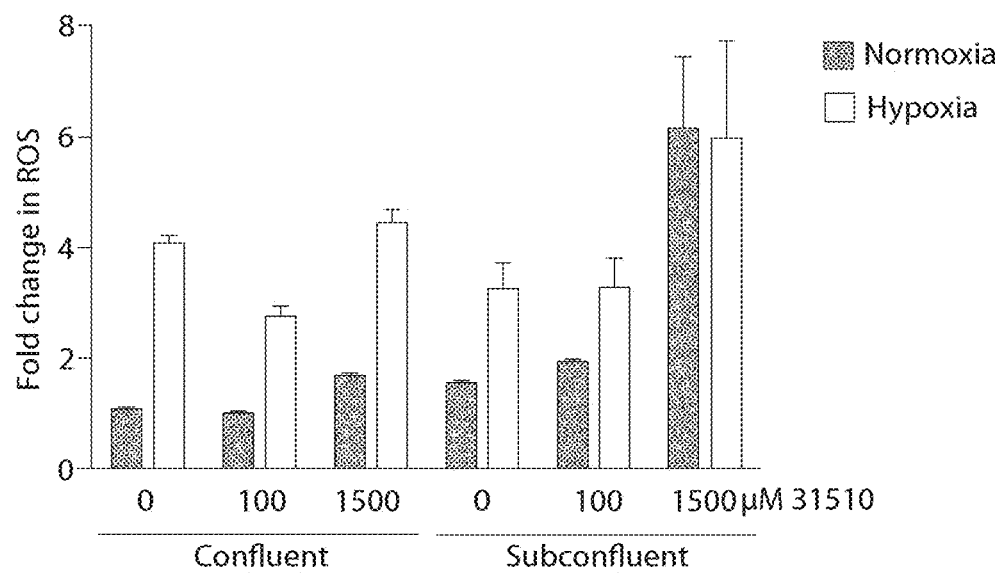

The response of HUVEC cells to normoxia and hypoxia in the presence of absence of CoQ10 was assessed. Specifically, HUVEC cells were grown in subconfluent and confluent cultures under normoxic or hypoxic conditions as described herein. The cells were also exposed to 0, 100, or 1500 µM CoQ10. Nitric oxide (NO) and reactive oxygen species (ROS) levels were determined using methods provided herein. As shown in FIG. 57, the HUVEC cells demonstrated a differential dose dependent generation of nitric oxide (NO) and reactive oxygen species (ROS) in response to CoQ10 and hypoxia.

Figure 58A:
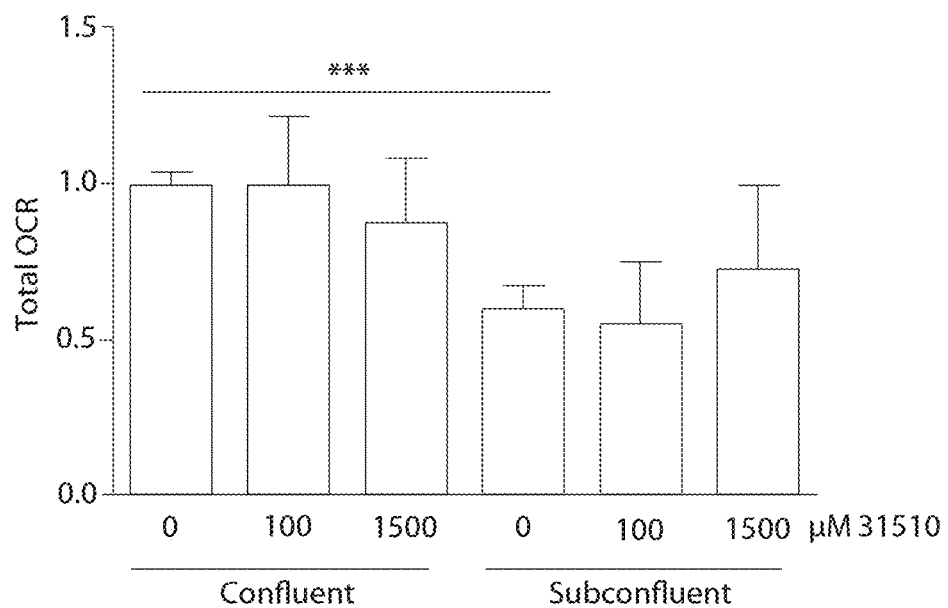
FIGS. 58A-D show endothelial cells were grown in subconfluent or confluent cultures in the presence or absence of CoQ10 to assess mitochondrial oxygen consumption under the indicated growth conditions. Assessment of Total OCR (A); Mitochondrial OCR (B); ATP production (C); ECAR (D) are shown.
Figure 58B:
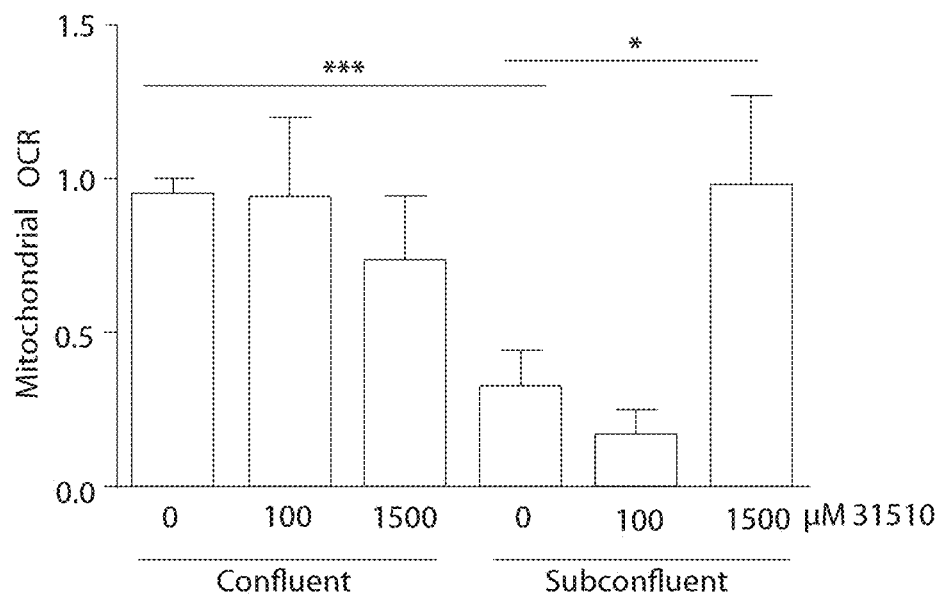
Figure 58C:
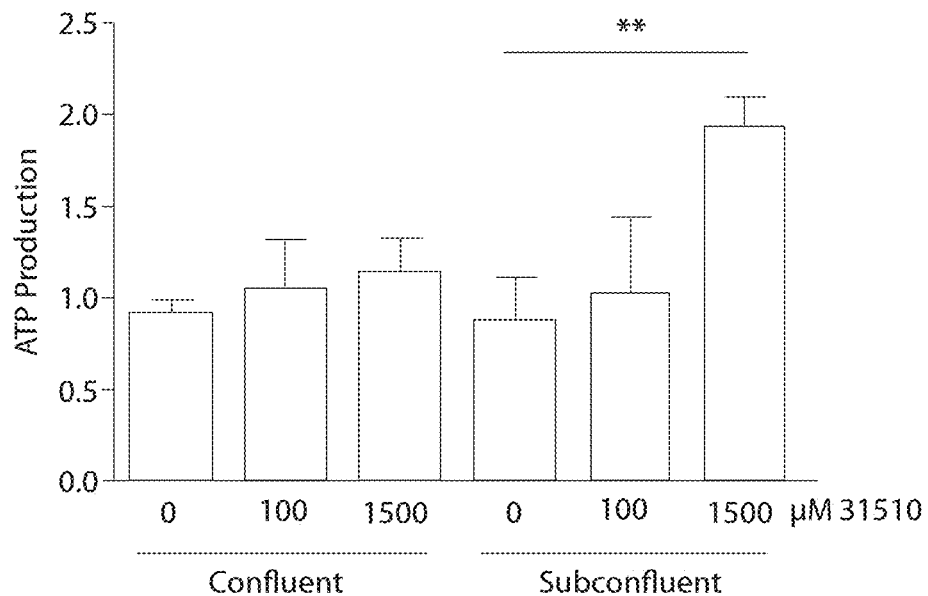
Figure 58D:
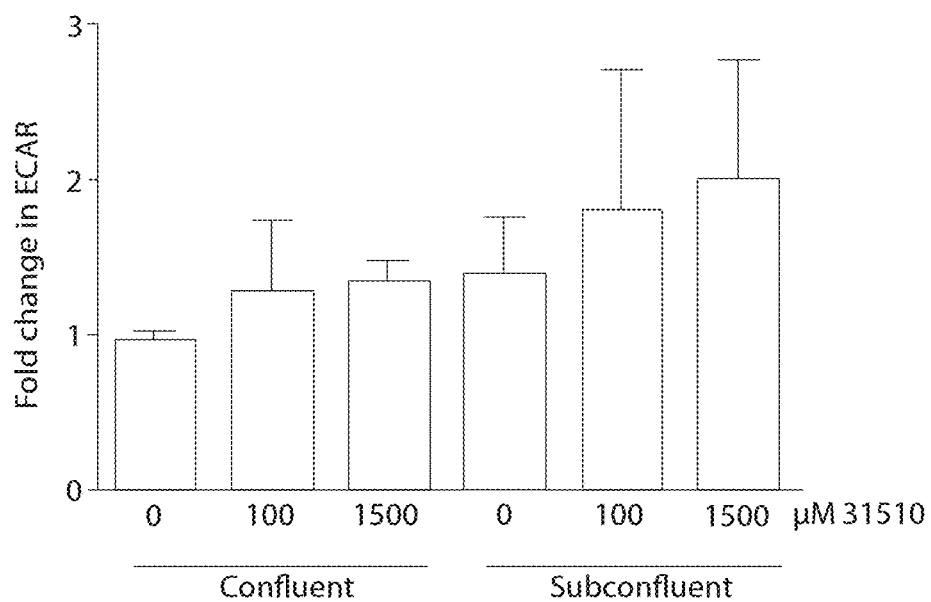

The bioenergetics of HUVEC cells were assessed in the presence of various concentrations of CoQ10. Specifically, HUVEC cells were grown in subconfluent or confluent conditions in the absence or presence of CoQ10 (10µ, 100, 1500 µM). Oxygen consumption rates (OCR), both total and mitochondrial, ATP production, and Extra Cellular Acidification Rate (ECAR) were assessed using Seahorse assays. HUVEC cells growing in sub-confluent cultures limit mitochondrial oxygen consumption when compared to confluent cultures as shown in FIG. 58A-D ((A) Total OCR; (B) Mitochondrial OCR; (C) ATP; (D) ECAR_. Addition of CoQ10 to sub-confluent cultures reverts mitochondrial OCR to confluent level OCR (FIG. 58B).

Example 8: Application of Functional Proteomics and Lipidomics to Elucidate Anti-Angiogenic Mechanism of CoQ10

Angiogenesis is a key enabling feature of tumor progression that provides oxygen and nutrients that are required for tumor cell growth. We have investigated the anti-angiogenic properties of CoQ10, an anti-tumor drug that is currently under investigation in human studies of cancer progression. CoQ10 impairs endothelial migration in 'scratch' assays and tube formation in 3-D MATRIGEL® tube formation assays. Addition of CoQ10 also impairs endothelial proliferation, as detected by G2/M phase cells and proliferating cell nuclear antigen (pCNA) protein. CoQ10 induces activation of caspase 3 and increases apoptosis of angiogenic/proliferating endothelial cells, whereas cell death of non-proliferating confluent endothelial cell cultures is decreased compared to controls.

In order to determine the intracellular proteomic profile of angiogenic proliferating endothelial cells and non-proliferating endothelial cells, we used a proteomic, lipidomic, and functional proteomic approach. Proteomic and shotgun lipidomic analysis were performed on a LTQ-OrbiTrap-Velos and Vantage-QqQ, respectively. The functional proteomics approach employed activity-based probes in combination with comparative proteomics. Kinases and other ATPases were specifically labeled with ATP-binding domain enrichment probes that interact with the active sites of enzymes in their native conformation. Enrichment was carried out through immunoprecipitation with streptavidin resin.

Figure 59A:
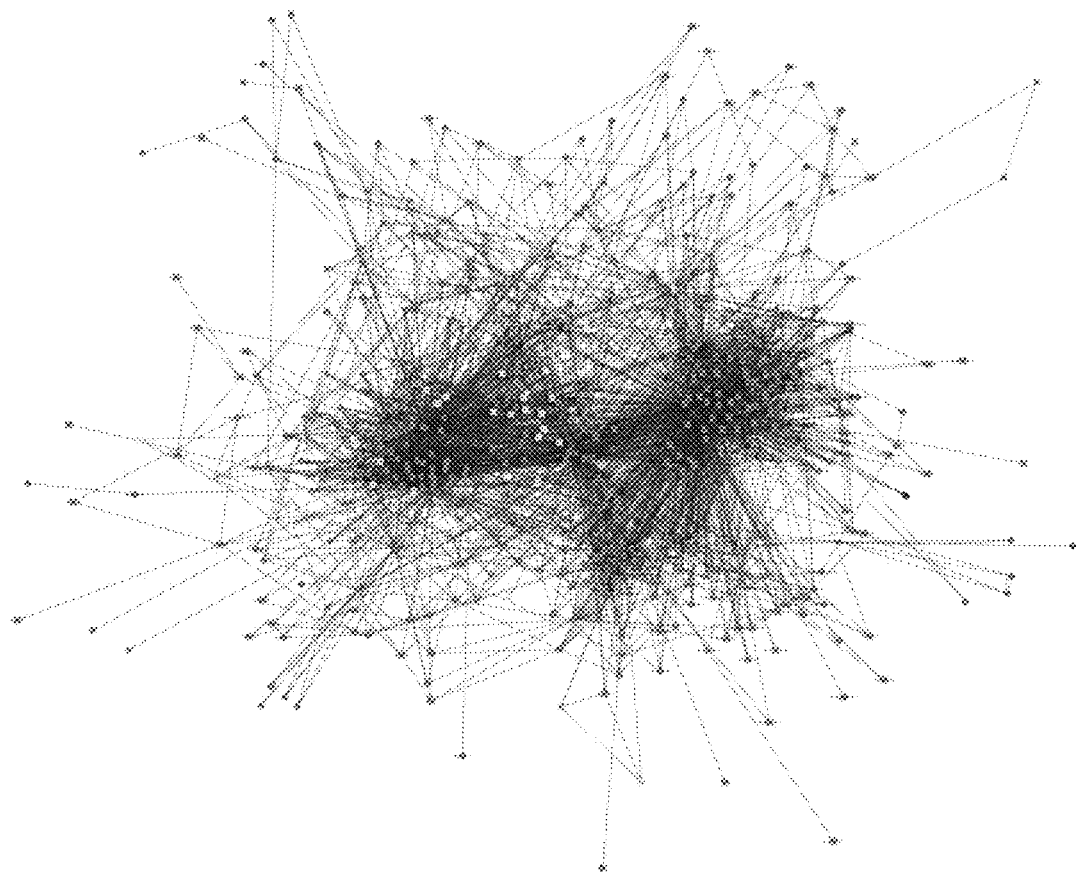
FIGS. 59A-C show results from the interrogative biology platform used to identify key biological functional nodes through modulating endothelial cell function by CoQ10. These nodes are represented by a full multi-omic network (A), a hub of a protein enriched network (B), and a hub of a kinase, lipidomic, and functional endpoint network (C).
Figure 59B:
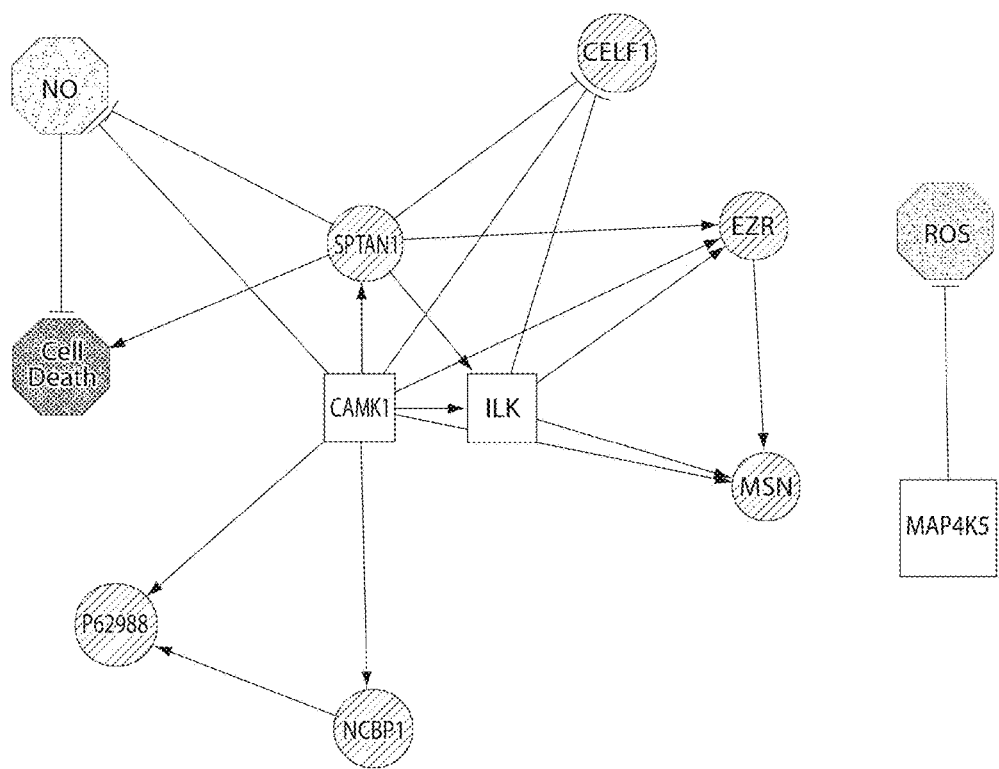
Figure 59C:
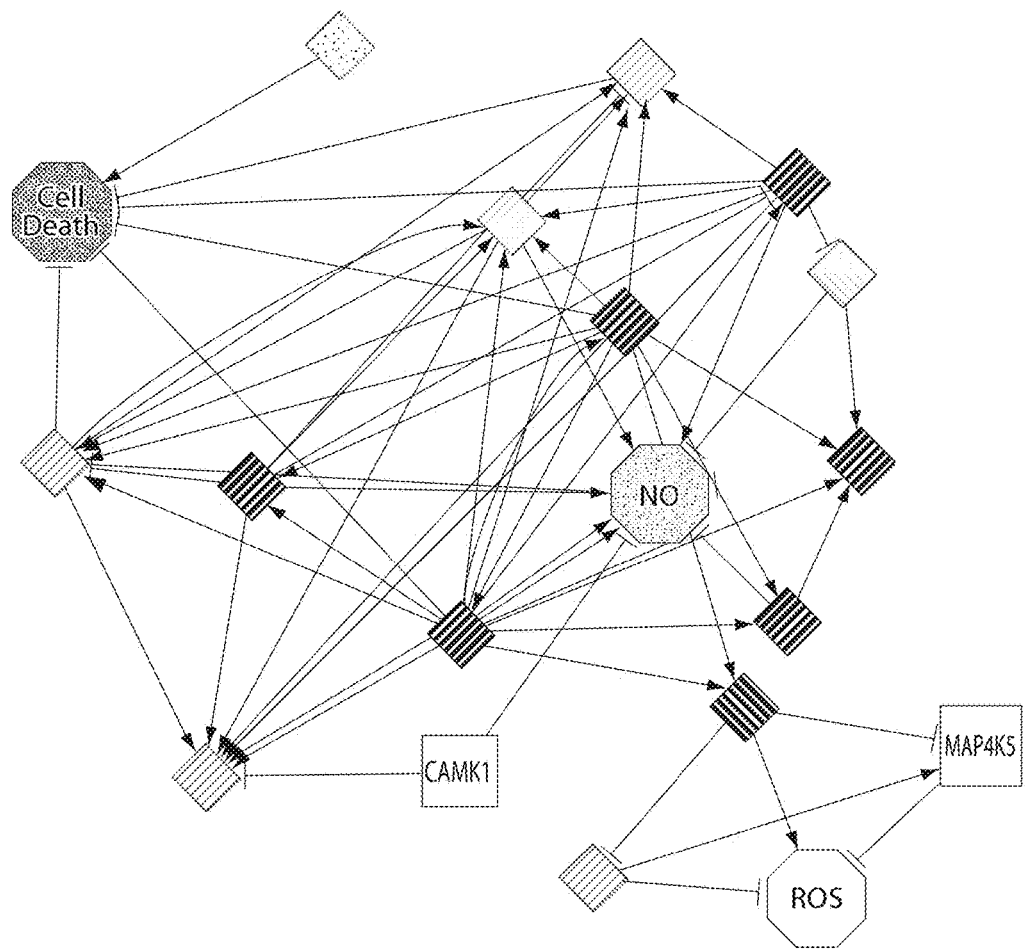

Using integrated lipidomics and proteomic platforms, and an AI based Bayesian informatics platform that generates causal lipid/protein/functional proteomics networks, novel proteins, lipids, and enzymes that modulate angiogenesis were identified. CoQ10 treated cells and comparison of normal and angiogenic endothelial cells were used to probe the global kinase activity. Comparative proteomics and enzyme activity data were integrated into the AI based Bayesian informatics platform to investigate causal networks of functional protein-protein interactions in order to elucidate the complexity and dynamics of angiogenesis. A causal interactive network is shown in FIG. 59A-C. Specifically, FIG. 59A is a full multiomic causal interaction network of lipids, proteins, and kinases. FIG. 59B shows a hub of a protein enriched network, and FIG. 59C shows a hub of a kinase, lipidomic, and functional endpoint network. In the networks, proteins are indicated by circles, kinases are indicated by squares, lipids are indicated by diamonds, and functional activity or cellular response are indicated by octagons. Some protein and kinase names are provided. The outputs from the platform confirmed known protein interactions.

In summary, using the platform technology, the anti-angiogenic mechanism of CoQ10 and the unique characteristics of proliferating endothelial cells by applying integrated functional proteomic assays to determine global changes in enzymatic activity have been investigated. Interrogative "omic" based platform robustly infers cellular intelligence. The AI-based network engineering approach to data mining to infer causality results in actionable biological intelligence. Moreover, the discovery platform allows for enhanced understanding of the pathophysiology of endothelial cells in response to environmental challenge, alteration in metabolic status, and production of adaptive molecules to mitigate physiologic perturbations.

Example 9: Employing Platform Technology to Build Models of Angiogenesis

In this example, the platform technology described in detail above in the detailed description is employed to integrate data obtained from a custom built angiogenesis model, and to identify novel proteins/pathways driving angiogenesis. Relational maps resulting from this analysis provide angiogenesis biomarkers.

Angiogenesis is a result of a complex series of signaling pathways that are not fully understood. Angiogenesis plays a role in a number of pathological conditions including, but not limited to, cancer. A systems approach combining protein and lipid signatures with functional end point assays specifically looking at cellular bioenergetics and mitochondrial membrane function is provided herein. As demonstrated above, sub-confluent HUVEC cells can be used to mimic an angiogenic state, whereas confluent HUVEC cells can be used to mimic a non-angiogenic, i.e., normal, state.

In an in vitro model, HUVEC cells are grown under conditions of contact inhibition (e.g., confluent cultures) or under conditions lacking contact inhibition (e.g., sub-confluent cultures, e.g., less than about 60% confluent, less than about 70% confluent, less than about 80% confluent, less than about 90% confluent; three-dimensional cultures; or cultures in which a patch of cells is removed by "scratching" the culture), in the presence or absence of an environmental influencer, such as an angiogenesis inhibitor, e.g., CoQ10, to create signatures and elucidate potential mechanisms of angiogenesis. The proteomic and lipidomic signatures are analyzed using the platform methods provided herein. Biomarkers of angiogenesis are further confirmed using wet lab methods. This approach serves as a powerful tool to understand mechanism of angiogenesis, allowing for the identification of new angiogenic biomarkers and the development and testing of agents that modulate angiogenesis.

Human umbilical vein endothelial cells are subject to conditions simulating an angiogenic environment experienced by the disease-relevant cells in vivo. Specifically, the cells are grown under conditions wherein growth is inhibited due to contact inhibition (i.e., normal cells) or under conditions wherein, in at least a portion of the culture, growth is not inhibited due to contact inhibition (i.e., angiogenic cells). For the sake of simplicity, such cells grown under conditions wherein, in at least a portion of the culture, growth is not inhibited due to contact inhibition will be referred to as non-confluent cultures.

The cell model comprising the above-mentioned cells, wherein the cells are grown in confluent or non-confluent cultures, is additionally "interrogated" by exposing the cells to an "environmental perturbation" by treating with an agent that modulates angiogenesis, e.g., an agent that inhibits angiogenesis. For example, the cells are treated with Coenzyme Q10 at various concentrations, for example, one or more of, 0, 50 µM, 100 µM, 250 µM, 500 µM, 750 µM, 1000 µM, 1250 µM, or 1500 µM. As provided herein, perturbation can include mechanical disruption of the cells, e.g., by "scratching" the culture or subculturing the cells at a lower density.

Cell samples from each condition with each perturbation treatment are collected at various times following treatment, for example, after 6, 12, 18, 24, 36, 48, 60, 72, 84, 96, 108, or 120 hours, or some time point therebetween, of treatment. For certain conditions, media samples are also collected and analyzed. Samples can then be analyzed for one or more of level of protein expression or activity, gene expression, and lipid levels.

iProfiling of changes in total cellular protein expression by quantitative proteomics is performed for cell and media samples collected for each condition and with each "environmental perturbation", i.e, Coenzyme Q10 treatment, using the techniques described above in the detailed description. Transcriptional profiling experiments are carried out, for example, using the Biorad® CFX-384 amplification system. Following data collection (Ct), the final fold change over control is determined using, for example, the δCt method as outlined in manufacturer's protocol. Lipidomics experiments are carried out using mass spectrometry. Functional assays such as Oxygen Consumption Rate (OCR) are measured, for example, by employing the Seahorse analyzer essentially as recommended by the manufacturer. OCR can be recorded by the electrodes in a 7 µl chamber created with the cartridge pushing against the seahorse culture plate.

In summary, morphological, enzymatic, and flow cytometric analysis revealed dramatic changes in apoptosis, migration, nitric oxide and ROS generation, and bioenergetic capacity in response to CoQ10 treatment. Lipidomic analysis revealed novel changes in lipid pathways mitigated by altering mitochondrial function and cell density. Proteomic integration utilizing the Platform methods revealed uncharacterized association of intracellular adaptation and signaling directed by mitochondrial modulation. Taken together, these studies reveal that CoQ10 alters endothelial migration, proliferation, apoptosis, nitric oxide, ROS, and protein/lipid architecture. A novel mechanism is presented herein where anti-tumor activity of CoQ10 is due to metabolic cross-talk of angiogenic and apoptotic factors to inhibit tumor recruitment of local blood supply for neo-vessel formation. Additionally, proteomic and lipidomic adaptation was associated with interactive networks which support the physiological requirements of endothelial cells in response to environmental stimuli. These data provide hallmark insight into the selective adaptation of tumor angiogenesis due to dysregulated mitochondrial metabolic control elements.

Example 10: Employing Platform Technology to Implement Multi Proteomics Models for Elucidating Enzymatic Activity In general, the enzymatic platform technology described in Example 5 above can be adapted to implement further methods for identifying a modulator of a biological system or disease process such as angiogenesis. The methods employ a model for angiogenesis, comprising cells associated with angiogenesis, to represents a characteristic aspect of angiogenesis. The model is used to obtain at least three levels of data, namely (i) a first data set representing global enzyme activity in the cells associated with angiogenesis, (ii) a second data set representing an effect of the global enzyme activity on the enzyme metabolites or substrates in the cells associated with angiogenesis, and (iii) a third data set representing global proteomic changes in the cells associated with angiogenesis. Additional data sets such as lipidomic, transctiptomic, metabolomics, and SNP data. The data is used to generate a consensus causal relationship network among the global enzyme activity, the effect of the global enzyme activity, and the global proteomic changes. The consensus causal relationship network is based solely on the first, second, and third data sets using a programmed computing device (i.e., not based on any other known biological relationship). The consensus causal relationship network is than used to identify a causal relationship unique to angiogenesis, where at least one gene or protein associated with the unique causal relationship is identified as a modulator of angiogenesis.

In this example, the platform technology was adapted to implement multi proteomics techniques for measuring enzyme activity related to angiogensis and the direct effects of that activity on the proteome; and thereby, provide a system that can be used to understand causal relationships between enzymes (e.g., kinases and/or proteases) and their metabolites/substrates in the context of global changes in the cellular proteome during angiogenesis. Such techniques can provide valuable insight because enzyme activity can be orthogonal to enzyme expression (e.g., activity down regulated and expression unregulated). Relational maps resulting from such an analysis can provide disease treatment targets by modulating angiogenesis, as well as diagnostic/prognostic markers associated with angiogenesis. Such targets and markers can provide for therapeutic compositions and methods. Techniques for establishing models, obtaining data sets, generating consensus causal relationship networks, and identifying causal relationships unique to angiogenesis are discussed in the summary, detailed description, and examples above. Further techniques for establishing models and obtaining data sets representing global enzyme activity and the effect of the global enzyme activity on the enzyme metabolites or substrates are provided below.

First, a model is established in accordance with the platform technology wherein, for example, cell lines are subjected to conditions simulating a disease and interrogated by exposure to an environmental perturbation (e.g., exposure to a modulator of angiogenesis, e.g., CoQ10, Avastin, a VEGF inhibitor, angiostatin, bevacizumab, change of confluency of HUVEC cells). A control is provided for comparison. Second, enzyme activity and its downstream effects are tracked in the context of global proteomic changes by analyzing (i) global enzymatic activity, (ii) the specific effect of the enzymatic activity on the proteome (e.g., the metabolites/substrates of the enzymatic activity), and (iii) the global effect on the cellular proteome. Third, the datasets are analyzed in accordance with the platform technology to identify modulators of interest. For example, an angiogenic model can be interrogated by a known modulator of angiogenesis; the effects of this perturbation to the system on the global kinase activity can be analyzed, along with the resulting effects on the phospho proteome and whole proteome; and the dataset can be analyzed by the AI based REFS™ system.

For example, HUVEC cells grown under various conditions can be used to simulate angiogenic and normal (e.g., non-angiogenic) states. As angiogenesis does not occur in adults except under specific circumstances, e.g., pregnancy, wound healing, etc. the presence of angiogenic markers identified by using this approach may be useful as markers indicative of a disease state, e.g., cancer, rheumatoid arthritis, age related macular degeneration, or diabetic retinopathy.

This illustrative example combines the power of (i) cell biology, (ii) integrated proteomics platforms and an informatics platform that generates causal protein networks to delineate the role of post-translation modification, e.g., phosphorylation, and enzymes that partake in such mechanisms, e.g., kinases, in the angiogenesis. In particular, this approach incorporates activity based proteomics employing ATP binding domain enrichment probes and phospho-proteome mapping of total proteins in angiogenesis models.

Comparative proteomics, phospho proteome and enzyme activity data are integrated into the AI based REFS™ informatics platform. Causal networks of protein interaction specifically from a functional stand point namely kinase/enzyme activity and potential targets that kinases can phosphorylate are then generated. In addition, using cellular functional read out, enzymes/kinases that modulate phosphorylation of targets and mechanistically drive pathophysiological cellular behavior are determined. The illustrative implementation outlined herein facilitates global characterization of cellular responses, insights into mechanisms of angiogenesis and potential targets/biomarkers for clinical management of angiogenesis.

As an illustrative example, cells representing normal cells and angiogenic cells are selected for comparison. As demonstrated herein, HUVEC cells when grown in sub-confluent cultures show characteristics of angiogenesis, whereas confluent HUVEC cells do not. Treatment of sub-confluent cultures of HUVEC cells with CoQ10 shifts the HUVEC cells to non-angiogenic state as demonstrated herein. As with the proteomics methods provided above, methods for analysis of enzymatic activity can include pairwise analysis of HUVEC cells grown under any conditions, and optionally further analysis of the results from the pairwise comparison with results from a third data set.

As an exemplary embodiment, equivalent numbers of HUVEC cells cultured in confluent and non-confluent cultures are harvested and the cells are enriched for the presence of peptides of interest, e.g., phosphopeptides. A comparative analysis is performed as in Example 5 to detect changes in enzymatic activity associated with angiogenesis.

INCORPORATION BY REFERENCE

The contents of all cited references (including literature references, patents, patent applications, GenBank Numbers in the version available on the date of filing the instant application, and websites) that maybe cited throughout this application are hereby expressly incorporated by reference in their entirety, as are the references cited therein. The practice of the present invention will employ, unless otherwise indicated, conventional techniques of protein formulation, which are well known in the art.

EQUIVALENTS

The invention may be embodied in other specific forms without departing from the spirit or essential characteristics thereof. The foregoing embodiments are therefore to be considered in all respects illustrative rather than limiting of the invention described herein. Scope of the invention is thus indicated by the appended claims rather than by the foregoing description, and all changes that come within the meaning and range of equivalency of the claims are therefore intended to be embraced herein.

APPENDIX A

Amino acid and cDNA sequences for relevant proteins

1. TCOF1: Treacher Collins-Franceschetti syndrome 1

LOCUS NM_000356
Protein: (SEQ ID NO: 1)
cDNA: (SEQ ID NO: 2)

2. TOP2A: *Homo sapiens* topoisomerase

LOCUS NM_001067
Protein: (SEQ ID NO: 3)
cDNA: (SEQ ID NO: 4)

3. CAMK2A: CAMK2A calcium/calmodulin-dependent protein kinase II alpha [*Homo sapiens*]

LOCUS NM_015981.3 (isoform 1)
Protein: (SEQ ID NO: 5)
cDNA: (SEQ ID NO: 6)
LOCUS NM_171825 (isoform 2)
Protein: (SEQ ID NO: 7)
cDNA: (SEQ ID NO: 8)

4. CDK1: CDK1 cyclin-dependent kinase 1 [*Homo sapiens*]

LOCUS NM_001170406 (isoform 4)
Protein: (SEQ ID NO: 9)
cDNA: (SEQ ID NO: 10)
LOCUS NM_001786 (isoform 1)
Protein: (SEQ ID NO: 11)
cDNA: (SEQ ID NO: 12)
LOCUS NM_033379 (isoform 2)
Protein: (SEQ ID NO: 13)
cDNA: (SEQ ID NO: 14)

5. CLTCL1: CLTCL1 clathrin, heavy chain-like 1 [*Homo sapiens*]

LOCUS NM_001835 (isoform 2)
Protein: (SEQ ID NO: 15)
cDNA: (SEQ ID NO: 16)
LOCUS NM_007098 (isoform 1)
Protein: (SEQ ID NO: 17)
cDNA: (SEQ ID NO: 18)

6. EIF4G1: EIF4G1 eukaryotic translation initiation factor 4 gamma, 1 [*Homo sapiens*]

LOCUS NM_001194946 (isoform 6)
Protein: (SEQ ID NO: 19)
cDNA: (SEQ ID NO: 20)

APPENDIX A-continued

Amino acid and cDNA sequences for relevant proteins

LOCUS NM_004953 (isoform 4)
Protein: (SEQ ID NO: 21)
cDNA: (SEQ ID NO: 22)
LOCUS NM_182917 (isoform 1)
Protein: (SEQ ID NO: 23)
cDNA: (SEQ ID NO: 24)
LOCUS NM_198241 (isoform 5)
Protein: (SEQ ID NO: 25)
cDNA: (SEQ ID NO: 26)
LOCUS NM_198242 (isoform 3)
Protein: (SEQ ID NO: 27)
cDNA: (SEQ ID NO: 28)
LOCUS NM_198244 (isoform 2)
Protein: (SEQ ID NO: 29)
cDNA: (SEQ ID NO: 30)

7. ENO1: ENO1 enolase 1, (alpha) [*Homo sapiens*]

LOCUS NM_001428
Protein: (SEQ ID NO: 31)
cDNA: (SEQ ID NO: 32)

8. FBL: FBL fibrillarin [*Homo sapiens*]

LOCUS NM_001436
Protein: (SEQ ID NO: 33)
cDNA: (SEQ ID NO: 34)

9. GSK3B: GSK3B glycogen synthase kinase 3 beta [*Homo sapiens*]

LOCUS NM_001146156 (isoform 2)
Protein: (SEQ ID NO: 35)
cDNA: (SEQ ID NO: 36)
LOCUS NM_002093 (isoform 1)
Protein: (SEQ ID NO: 37)
cDNA: (SEQ ID NO: 38)

10. HDLBP: HDLBP high density lipoprotein binding protein [*Homo sapiens*]

LOCUS NM_001243900 (isoform b)
Protein: (SEQ ID NO: 39)
cDNA: (SEQ ID NO: 40)
LOCUS NM_005336 (isoform a)
Protein: (SEQ ID NO: 41)
cDNA: (SEQ ID NO: 42)
LOCUS NM_203346 (isoform a, transcript variant 2)
Protein: (SEQ ID NO: 43)
cDNA: (SEQ ID NO: 44)

11. HIST1H2BA: HIST1H2BA histone cluster 1, H2ba [*Homo sapiens*]

LOCUS NM_170610
Protein: (SEQ ID NO: 45)
cDNA: (SEQ ID NO: 46)

12. HMGB2: HMGB2 high mobility group box 2 [*Homo sapiens*]

LOCUS NM_001130688 (isoform 2)
Protein: (SEQ ID NO: 47)
cDNA: (SEQ ID NO: 48)
LOCUS NM_001130689 (isoform 3)
Protein: (SEQ ID NO: 49)
cDNA: (SEQ ID NO: 50)
LOCUS NM_002129 (isoform 1)
Protein: (SEQ ID NO: 51)
cDNA: (SEQ ID NO: 52)

13. HNRNPK: HNRNPK heterogeneous nuclear ribonucleoprotein K [*Homo sapiens*]

LOCUS NM_002140 (isoform a variant 1)
Protein: (SEQ ID NO: 53)
cDNA: (SEQ ID NO: 54)
LOCUS NM_031262 (isoform 3 variant 3)
Protein (SEQ ID NO: 55)
cDNA: (SEQ ID NO: 56)
LOCUS NM_031263 (isoform a variant 2)
Protein: (SEQ ID NO: 57)
cDNA: (SEQ ID NO: 58)

APPENDIX A-continued

Amino acid and cDNA sequences for relevant proteins

14. HNRPDL: HNRPDL heterogeneous nuclear ribonucleoprotein D-like [*Homo sapiens*]

LOCUS  NM_001207000    (isoform B)
    Protein:  (SEQ ID NO: 59)
    cDNA:  (SEQ ID NO: 60)
    LOCUS  NM_031372    (isoform a)
    Protein:  (SEQ ID NO: 61)
    cDNA:  (SEQ ID NO: 62)

15. HSPA9: HSPA9 heat shock 70 kDa protein 9 (mortalin) [*Homo sapiens*]

LOCUS  NM_004134
    Protein:  (SEQ ID NO: 63)
    cDNA:  (SEQ ID NO: 64)

16. MAP2K2: MAP2K2 mitogen-activated protein kinase kinase 2 [*Homo sapiens*]

LOCUS  NM_030662
    Protein:  (SEQ ID NO: 65)
    cDNA:  (SEQ ID NO: 66)

17. LDHA: LDHA lactate dehydrogenase A [*Homo sapiens*]

LOCUS  NM_001135239    (isoform 2)
    Protein:  (SEQ ID NO: 67)
    cDNA:  (SEQ ID NO: 68)
    LOCUS  NM_001165414    (isoform 3)
    Protein:  (SEQ ID NO: 69)
    cDNA:  (SEQ ID NO: 70)
    LOCUS  NM_001165415    (isoform 4)
    Protein:  (SEQ ID NO: 71)
    cDNA:  (SEQ ID NO: 72)
    LOCUS  NM_001165416    (isoform 5)
    Protein:  (SEQ ID NO: 73)
    cDNA:  (SEQ ID NO: 74)
    LOCUS  NM_005566    (isoform 1)
    Protein:  (SEQ ID NO: 75)
    cDNA:  (SEQ ID NO: 76)

18. MAP4: MAP4 microtubule-associated protein 4 [*Homo sapiens*]

LOCUS  NM_001134364    (isoform 4)
    Protein:  (SEQ ID NO: 77)
    cDNA:  (SEQ ID NO: 78)
    LOCUS  NM_002375    (isoform 1)
    Protein:  (SEQ ID NO: 79)
    cDNA:  (SEQ ID NO: 80)
    LOCUS  NM_030885    (isoform 3)
    Protein:  (SEQ ID NO: 81)
    cDNA:  (SEQ ID NO: 82)

19. MAPK1: MAPK1 mitogen-activated protein kinase 1 [*Homo sapiens*]

LOCUS  NM_002745    (isoform 1)
    Protein:  (SEQ ID NO: 83)
    cDNA:  (SEQ ID NO: 84)
    LOCUS  NM_138957    (isoform 2)
    Protein:  (SEQ ID NO: 85)
    cDNA:  (SEQ ID NO: 86)

20. MARCKS: MARCKS myristoylated alanine-rich protein kinase C substrate [*Homo sapiens*]

LOCUS  NM_002356
    Protein:  (SEQ ID NO: 87)
    cDNA:  (SEQ ID NO: 88)

21. NME1: NME1 NME/NM23 nucleoside diphosphate kinase 1 [*Homo sapiens*]

LOCUS  NM_000269    (isoform b)
    Protein:  (SEQ ID NO: 89)
    cDNA:  (SEQ ID NO: 90)
    LOCUS  NM_198175    (isoform 1)
    Protein:  (SEQ ID NO: 91)
    cDNA:  (SEQ ID NO: 92)

22. NME2: NME2 NME/NM23 nucleoside diphosphate kinase 2 [*Homo sapiens*]

LOCUS  NM_001018137    (isoform a variant 2)
    Protein:  (SEQ ID NO: 93)
    cDNA:  (SEQ ID NO: 94)
    LOCUS  NM_001018138    (isoform a variant 3)
    Protein:  (SEQ ID NO: 95)
    cDNA:  (SEQ ID NO: 96)
    LOCUS  NM_001018139    (isoform a variant 4)
    Protein:  (SEQ ID NO: 97)
    cDNA:  (SEQ ID NO: 98)
    LOCUS  NM_001198682    (isoform b variant 5)
    Protein:  (SEQ ID NO: 99)
    cDNA:  (SEQ ID NO: 100)
    LOCUS  NM_002512    (isoform a variant 1)
    Protein:  (SEQ ID NO: 101)
    cDNA:  (SEQ ID NO: 102)

23. PGK1: PGK1 phosphoglycerate kinase 1 [*Homo sapiens*]

LOCUS  NM_000291
    Protein:  (SEQ ID NO: 103)
    cDNA:  (SEQ ID NO: 104)

24. PGK2: PGK2 phosphoglycerate kinase 2 [*Homo sapiens*]

LOCUS  NM_138733
    Protein:  (SEQ ID NO: 105)
    cDNA:  (SEQ ID NO: 106)

25. RAB7A: RAB7A RAB7A, member RAS oncogene family [*Homo sapiens*]

LOCUS  NM_004637
    Protein:  (SEQ ID NO: 107)
    cDNA:  (SEQ ID NO: 108)

26. RPL17: RPL17 ribosomal protein L17 [*Homo sapiens*]

LOCUS  NM_000985    (isoform A variant 1)
    Protein:  (SEQ ID NO: 109)
    cDNA:  (SEQ ID NO: 110)
    LOCUS  NM_001035006    (isoform a variant 2)
    Protein:  (SEQ ID NO: 111)
    cDNA:  (SEQ ID NO: 112)
    LOCUS  NM_001199340    (isoform a variant 3)
    Protein:  (SEQ ID NO: 113)
    cDNA:  (SEQ ID NO: 114)
    LOCUS  NM_001199341    (isoform a variant 4)
    Protein:  (SEQ ID NO: 115)
    cDNA:  (SEQ ID NO: 116)
    LOCUS  NM_001199342    (isoform A variant 5)
    Protein:  (SEQ ID NO: 117)
    cDNA:  (SEQ ID NO: 118)
    LOCUS  NM_001199343    (isoform a variant 6)
    Protein:  (SEQ ID NO: 119)
    cDNA:  (SEQ ID NO: 120)
    LOCUS  NM_001199344    (isoform a variant 7)
    Protein:  (SEQ ID NO: 121)
    cDNA:  (SEQ ID NO: 122)
    LOCUS  NM_001199345    (isoform b variant 8)
    Protein:  (SEQ ID NO: 123)
    cDNA:  (SEQ ID NO: 124)

27. RPL28: RPL28 ribosomal protein L28 [*Homo sapiens*]

LOCUS  NM_000991    (isoform 2)
    Protein:  (SEQ ID NO: 125)
    cDNA:  (SEQ ID NO: 126)
    LOCUS  NM_001136134    (isoform 1)
    Protein:  (SEQ ID NO: 127)
    cDNA:  (SEQ ID NO: 128)
    LOCUS  NM_001136135    (isoform 3)
    Protein:  (SEQ ID NO: 129)
    cDNA:  (SEQ ID NO: 130)
    LOCUS  NM_001136136    (isoform 4)
    Protein:  (SEQ ID NO: 131)
    cDNA:  (SEQ ID NO: 132)
    LOCUS  NM_001136137    (isoform 5)
    Protein:  (SEQ ID NO: 133)
    cDNA:  (SEQ ID NO: 134)

28. RPS5: RPS5 ribosomal protein S5 [*Homo sapiens*]

LOCUS  NM_001009
    Protein:  (SEQ ID NO: 135)
    cDNA:  (SEQ ID NO: 136)

APPENDIX A-continued

Amino acid and cDNA sequences for relevant proteins

29. RPS6: RPS6 ribosomal protein S6 [*Homo sapiens*]

LOCUS NM_001010
Protein: (SEQ ID NO: 137)
cDNA: (SEQ ID NO: 138)

30. SLTM: SLTM SAFB-like, transcription modulator [*Homo sapiens*]

LOCUS NM_001013843 (isoform b)
Protein: (SEQ ID NO: 139)
cDNA: (SEQ ID NO: 140)
LOCUS NM_024755 (isoform a)
Protein: (SEQ ID NO: 141)
cDNA: (SEQ ID NO: 142)

31. TMED4: TMED4 transmembrane emp24 protein transport domain containing 4 [*Homo sapiens*]

LOCUS NM_182547
Protein: (SEQ ID NO: 143)
cDNA: (SEQ ID NO: 144)

32. TNRCBA: ADRBK1 adrenergic, beta, receptor kinase 1 [*Homo sapiens*]

LOCUS NM_001619
Protein: (SEQ ID NO: 145)
cDNA: (SEQ ID NO: 146)

APPENDIX A-continued

Amino acid and cDNA sequences for relevant proteins

33. TUBB: TUBB tubulin, beta class I [*Homo sapiens*]

LOCUS NM_178014
Protein: (SEQ ID NO: 147)
cDNA: (SEQ ID NO: 148)

34. UBE2I: UBE2I ubiquitin-conjugating enzyme E2I [*Homo sapiens*]

LOCUS NM_003345 (variant 1)
Protein: (SEQ ID NO: 149)
cDNA: (SEQ ID NO: 150)
LOCUS NM_194259 (variant 2)
Protein: (SEQ ID NO: 151)
cDNA: (SEQ ID NO: 152)
LOCUS NM_194260 (variant 3)
Protein: (SEQ ID NO: 153)
cDNA: (SEQ ID NO: 154)
LOCUS NM_194261 (variant 4)
Protein: (SEQ ID NO: 155)
cDNA: (SEQ ID NO: 156)

SEQUENCE LISTING (156 sequences)

SEQ ID NO: 1 - protein, 1411 aa, Homo sapiens
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQVIKPPLIFVDPNRSPAGPAATPAQAQAASTPRKARASESTARSSSSESEDEDVIPATQCLTPGIRTNVVTMPTAHPRIAPKASMAGASSSKESSRISDGKKQEGPATQVSKKNPASLPLTQAALKVLAQKASEAQPPVARTQPSSGVDSAVGTLPATSPQSTSVQAKGTNKLRKPKLPEVQQATKAPESSDDSEDSSDSSSGSEEDGEGPQGAKSAHTLGPTPSRTETLVEETAAESSEDDVVAPSQSLLSGYMTPGLTPANSQASKATPKLDSSPSVSSTLAAKDDPDGKQEAKPQQAAGMLSPKTGGKEAASGTTPQKSRKPKKGAGNPQASTLALQSNITQCLLGQPWPLNEAQVQASVVKVLTELLEQERKKVVDTTKESSRKGWESRKRKLSGDQPAARTPRSKKKKKLGAGEGGEASVSPEKTSTTSKGKAKRDKASGDVKEKKGKGSLGSQGAKDEPEEELQKGMGTVEGGDQSNPKSKKEKKKSDKRKKDKEKKEKKKKAKKASTKDSESPSQKKKKKKKKTAEQTV

SEQ ID NO: 2 - DNA, 4882 bp, Homo sapiens
gaaagaggagccggaagtgtggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgcaaaaaaaaaaaaaaaaaa

SEQ ID NO: 3 - protein, 1531 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 4 - DNA, 5753 bp, Homo sapiens
gattggctggtctgcttcgggcgggctaaaggaaggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaaccca

SEQ ID NO: 5 - protein, 489 aa, Homo sapiens
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKKRKSSSSVQLMESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 6 - DNA, 4918 bp, Homo sapiens
ggttgccatggggacctggatgctgacgaaggctcgcgaggctgtgagcagccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggtggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtaccctcgaccctcctgggtgttggttggagcagaactggtgaggatgtttgatccgagattttctgagctctccccaatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgtggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttctttttttttttcttttcttttttaaaaatatgtggctgtgaacttgaatgaacactgctcaaactttctgctattggggggggcgggtgggatgggaagaaggggcgtttgttttattcttggtgttttcagtgcaataaatagctacaaacttctgtgcaaaaaaaaaaaaaaa

SEQ ID NO: 7 - protein, 478 aa, Homo sapiens
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 8 - DNA, 4885 bp, Homo sapiens
ggttgccatggggacctggatgctgacgaaggctcgcgaggctgtgagcagccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggtggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtaccctcgaccctcctgggtgttggttggagcagaactggtgaggatgtttgatccgagattttctgagctctccccaatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgtggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttctttttttttttcttttcttttttaaaaatatgtggctgtgaacttgaatgaacactgctcaaactttctgctattggggggggcgggtgggatgggaagaaggggcgtttgttttattcttggtgttttcagtgcaataaatagctacaaacttctgtgcaaaaaaaaaaaaaaa

SEQ ID NO: 9 - protein, 109 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKVKA

SEQ ID NO: 10 - DNA, 1754 bp, Homo sapiens
agccgccctttcctctttctttcgcgctctagccacccgggaaggcctgcccagcgtagctgggctctgattggctgctttgaaagtctacgggctacccgattggtgaatccggggccctttagcgcggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtaaaagcttaactaattttattaatatttatgcactgtggatataaagggactatatatagaagtccctgcattttgtgggaatatgcttggaaaaagtgttagaataagaaaaagtatttcatttttctccctcatggttagtttatacaggttagagatacccatgttattaccagatagtgtttctagtaagtaaaaattagtgcctgagataacatagaactggtaggtattgttggaagctagggtagtctggtctttctttggctgtcagatacatgtaaaacaaagtaatgaaagcctagggcagagtggtggttgtaggtgttttattccagttttgaacatgttttggtcaatttattgtagacatttattatatttcaggtaaattataaaattgtatagttttaagtactgaagtatataaaagtgtcttattcttgcaccagttctaccaaaccactctgcagaggtagcgctgttagttttatttgtaatcttacacttgtatgtatgttcactttgtatgtatataaagatttttttttttacacaaggtggacttatttgcatatgtatatatacatattttcccttttttgtgtaaaacattatcaagacgtagatctacctatgtctatttacatttttgatataattaaaccacttccatattgatgaacatttaaattattttccaacttggttattgttgctcttattaacagtactgcactgaatgtccttatagatatttatcttcgtatgcaactttataggataaatttttagaatgggaatgatggattgaagatgtttatttacattttgatagatattgccggttgccccctaaaaaacttgtagcaatttactcttaaatactcatggtgtgtaatacttattgttttagtacatcattgccaaaacttggttttatcaatctgttaactatgtgaaaaaggcatattaagattgttttaattttatatttcatgacaatttaacacttcatatttagctattataaaccgcctatattttcgttaggatacgttctttaacaatcttgcatgacttttggactttctgcttttatgtcttgcttaagtcttcctcactcaaagatcgaatgtattagaataatacatgtcagtatttttctggtagttttagtaagtcctgtcttccacacatactttttttgtcttaaattctgtattaagatttattttgacttaaaaactgggatacagattctgctttatctttttcc

SEQ ID NO: 11 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 12 - DNA, 1923 bp, Homo sapiens
agcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataaaaaaaaaaaa

SEQ ID NO: 13 - protein, 240 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 14 - DNA, 1752 bp, Homo sapiens
agcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataaaaaaaaaaaa

SEQ ID NO: 15 - protein, 1583 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 16 - DNA, 5371 bp, Homo sapiens
accggtcagcccgcgcgaggggtcggcgttcattcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaaaaaaaaaaaaaaaaaaaaaaaaaaaaa

SEQ ID NO: 17 - protein, 1640 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQGLRASIDAYDNFDNISLAQQLEKHQLMEFRCIAAYLYKGNNWWAQSVELCKKDHLYKDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 18 - DNA, 5542 bp, Homo sapiens
accggtcagcccgcgcgaggggtcggcgttcattcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaaaaaaaaaaaaaaaaaaaaaaaaaaaaa

SEQ ID NO: 19 - protein, 1606 aa, Homo sapiens
MNKAPQSTGPPPAPSPGLPQPAFPPGQTAPVVFSTPQATQMNTPSQPRQGGFRSLQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 20 - DNA, 5559 bp, Homo sapiens
cggcggcgcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagggaggattcaggtctctgcagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctcaaaaaaaaaaaaaaaaaa

SEQ ID NO: 21 - protein, 1404 aa, Homo sapiens
MSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPQAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 22 - DNA, 5050 bp, Homo sapiens
tctagatgggggtcctgggccccagggtgtgcagccactgacttggggactgctggtggggtagggatgagggagggaggggcattgtgatgtacagggctgctctgtgagatcaagggtctcttaagggtgggagctggggcagggactacgagagcagccagatgggctgaaagtggaactcaaggggtttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctcaaaaaaaaaaaaaaaaaa

SEQ ID NO: 23 - protein, 1600 aa, Homo sapiens
MNKAPQSTGPPPAPSPGLPQPAFPPGQTAPVVFSTPQATQMNTPSQPRQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPQAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 24 - DNA, 5686 bp, Homo sapiens
tcacttgcctgaaaccggctcctcgacggccgccgcccgcctggccttttagggcctgactcccgcccttcctggcctacactcctgggcggcggcaggcctagcttctggcccagtgcgggttccccggcggcaggcgtatcctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctcaaaaaaaaaaaaaaaaaa

SEQ ID NO: 25 - protein, 1599 aa, Homo sapiens
MNKAPQSTGPPPAPSPGLPQPAFPPGQTAPVVFSTPQATQMNTPSQPRQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 26 - DNA, 5538 bp, Homo sapiens
cggcggcgcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctcaaaaaaaaaaaaaaaaaa

SEQ ID NO: 27 - protein, 1435 aa, Homo sapiens
MNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 28 - DNA, 5123 bp, Homo sapiens
cggcggcgcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctcaaaaaaaaaaaaaaaaaa

SEQ ID NO: 29 - protein, 1512 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 30 - DNA, 5300 bp, Homo sapiens
cggcggcgcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctcaaaaaaaaaaaaaaaaaa

SEQ ID NO: 31 - protein, 434 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 32 - DNA, 2204 bp, Homo sapiens
gtggggccccagagcgacgctgagtgcgtgcgggactcggagtacgtgacggagccccgagctctcatgcccgccacgccgccccgggccatcccccggagccccggctccgcacaccccagttcggctcaccggtcctatctggggccagagtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgagaataaaaaaaaaaaaaaaaaa

SEQ ID NO: 33 - protein, 321 aa, Homo sapiens
MKPGFSPRGGGFGGRGGFGDRGGRGGRGGFGGGRGRGGGFRGRGRGGGGGGGGGGGGGRGGGGFHSGGNRGRGRGGKRGNQSGKNVMVEPHRHEGVFICRGKEDALVTKNLVPGESVYGEKRVSISEGDDKIEYRAWNPFRSKLAAAILGGVDQIHIKPGAKVLYLGAASGTTVSHVSDIVGPDGLVYAVEFSHRSGRDLINLAKKRTNIIPVIEDARHPHKYRMLIAMVDVIFADVAQPDQTRIVALNAHTFLRNGGHFVISIKANCIDSTASAEAVFASEVKKMQQENMKPQEQLTLEPYERDHAVVVGVYRPPPKVKN

SEQ ID NO: 34 - DNA, 1171 bp, Homo sapiens
gcgtcacgcagcgcacgtcgccgcgcgcctgcgctcttttccacgtgcgaaagccccggactcgtggagttgtgaacgccgcggactccggagccgcacaaaccagggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtctcccaaaaaaa

SEQ ID NO: 35 - protein, 420 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 36 - DNA, 7095 bp, Homo sapiens
cgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcgaggagccgctgcctggggtctgaagggagctgcctccgccaccgccatggccgctggatccagccgccgcctgcagctgctcctggcgcaatgaggagaggagccgccgccaccgccaccgcccgcctctgactgactcgcgactccgccgccctctagttcgccgggcccctgccgtcagcccgccggatcccgcggcttgccggagctgcagcgtttcccgtcgcatctccgagccaccccctccctccctctccctccctcctacccatccccctttctcttcaagcgtgagactcgtgatccttccgccgcttcccttcttcattgactcggaaaaaaaatccccgaggaaaatataatattcgaagtactcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaaatcctgttcattttagtgttcaatttttttattattattgttgttcttatttaaccttgtaaaatatctataaatacaaaccaatttcattgtattctcactttgagggagatccagggggtgggaggggttgtggggagggggaaagcggagcactagaacatacaatctctctcccacgacaatctttttttattaaaagtctgctgttgtatactttaaaaacaggactcctgcctcatgccccttccacaaaagaagaaaacctttttctgtgctgatgggtttttttgaactttgttttcttttaaagtctagtgtgagactttggtatagtgcacagcttgaaattggttgggagcttagcaggtataactcaacggggacttaaatgtcacttgtaaaattaatccatatcttcgggtatttatagacttgcctttggcatgttggtggcaggtgtggcagacaaagaaatgtgtatcattcgtaacccagggaggtcaataaagtttggaactctacagggaagattcttagtagatttgttaaggttttgttttgctctcagttagtgctagtgatgtagaggcttgtacaggaggctgccagaggggaagcagcaagcaagactcaggcacacatgctctacaggtggctctttgtttgcctgaccaaagttctttgcaaatcttagcacagtttcaaactagtgacctgggaggagatggaaggggtgttgagcaggctgagctagctgctgaggtcaaaggctgatgagcccagaggaaggggacaggtcagggatacatctcaccactgtgaataagtttgtccagatttttttctaaagttacttcccttggaaagatacacttgagaggacattgtagttaaataatgtgaactgtaacagtcatctactggtttatttttcatattttttaattgaaaattgagcttgcagaaatagccacattctacacatagttctaattttaaatccaaatctagaatctgtatttaatttgttttttaacctcatgctttttacatttatttattgatgcatgtcagatggtagaaatattaaaaactacacatcagaatgatacagtcacttatacctgctgactttataggaaagctgatgatataaatgtgtgtatatatgttatatatacatatattcaatactgcctttttttttgtctacagtatcaaaattgactggttgaagcatgagaagaatgtttcccccacacccagttaagagtttttgtgtctgttttctttgtgtatcagtgaacgatgttaagaatcagtctctctttttgaagaaaaagcaatattccttggaaagcaaggagaattgaaggactatgtttgccgtgaggaaatagattttcatgactagtttgttttatacttttaaggttggcatctatgtgggccttatatactctaaaatgaactttagtcaccttggtgcttatgggccattacttgacctatgaatctttaaggcacaatcagttgtactttacatttaaagatcacttgagtgatggccgcctttccctcctacccgctccttccccacatgccttccaaggttagctggtaactgtagggctgcagagctgagcccatggttgtgtgtaacttgccctcaccctcctcattgccaccttaggtcactttatgggtctcgtcctccagagggttcggaagtggagtctgttggcagccctcctgcaggccctagcaccctgtcctgctccttaactgtgtgtgtgactctccaagagagttgtcctgcctgctgaagtgaaccagtacccagaaagacaactgtgagccatcttggttttcactcgctgtttagctgaggtcttgggccacaaaaggggtttcacaaacctctggatatatcagagtttatgagaaaggaaacatgctcagtcaaaccaaatcaaacaaattgaattttatgttttataaagtgcttctgaaagctaagatttgaaagaagtctgaaatcaaagtatttggcagcataactccttaaaggtagtggcgttgatagaccattttcagacagaatttataaagaatctgaaaaggcaggtctgtgatagagaaatggacctgcattcagatccaactgcccagcaagcgtttggatgcagacactgctctggacgtggtatactccccagagtccataaaaatcagtgcttattttaggaaacaggttgccccccacaactggggtaaaagaagagagaaaagtcacgcttttctctcatttcattgtgtgtgcatgtgtgcgtgtgtgtgtgtgtgtgtgtgtgctgagatgtgtgatttttctttctcaaggatcatggtgggatcacagaactcttttatacaagtgagatccaggtctctgaatatctttttgtatataataataataaaaagctcctcaccaaattcaagcttgtacattatattttctttctgtgtttttaaatttaagttttattgttttgtatgtaaatatgtggacccaggaactgttattaatgagcaaaaagttactgttcagggcagtgattctgtttaataatcagacaaaatgtagacgagctttttaaagccatatagttttaactctgtacagtaggtaccggcctgtattattgtaacaataactctagcaatgtatagtgtatctatatagtttggagtgccttcgcttccatgtgtttttttttttaatttgttcttttttaaattttaattggtttcctttatccatgtctccctgtccaccccctttccctttgaaataataactcactcataacagtatctttgccccttccacagttaagtttcagtgataccatactcaggagtgggaagaggaaatcatattcgtaatttcatttcgttgaagccctgcctttgttttggttctgaatgtctttcctcctcggtagcagtgagaccggtttcatttcatacttagtccattcagggacttagtgtagcaccagggagccctagagctggaggatatcgaatagattaaattttgctcgtctcttccacaagccctaaccatgggtcttaaaaacagcagattctgggagccttccatgctctctctctctcctcttttatctacttccctcccaaatgagagagtgacagagaattgtttttttataaatcgaagtttcttaatagtatcaggttttgatacgtcagtggtctaaaatgctatagtgcaattactagcagttactgcacggagtgccaccgtgccaatagaggactgttgttttaacaagggaactcttagcccatttcctccctcccgccatctctacccttgctcaatgaaatatcattttaatttcttttaaaaaaaatcagtttaattcttactgtgtgcccaacacgaaggccttttttgaaagaaaaatagaatgttttgcctcaaagtagtccatataaaatgtcttgaatagaagaaaaaactaccaaaccaaaggttactatttttgaaacatcgtgtgttcattccagcaaggcagaagactgcaccttctttccagtgacatgctgtgtcattttttttaagtcctcttaatttttagacacatttttggtttatgttttaacaatgtatgcctaaccagtcatcttgtctgcaccaatgcaaaggtttctgagaggagtattctctatccctgtggatatgaagacactggcatttcatctatttttccctttcctttttaaaggatttaactttggaatcttccaaaggaagtttggccaatgccagatccccaggaatttggggggttttctttcttttcaactgaaattgtatctgattcctactgttcatgttagtgatcatctaatcacagagccaaacacttttctcccctgtgtggaaaagtaggtatgctttacaataaaatctgtcttttctggtagaaacctgagccactgaaaataaaagagacaactagaagcacagtagagtcccagactgagatctacctttgagaggctttgaaagtaatccctggggtttggattattttcacaagggttatgccgttttattcaagtttgttgctccgttttgcacctctgcaataaaagcaaaatgacaaccagtacataaggggttagcttgacaaagtagacttccttgtgttaatttttaagtttttttttccttaactatatctgtctacaggcagatacagatagttgtatgaaaatctgcttgcctgtaaaatttgcatttataaatgtgttgccgatggatcacttgggcctgtacacataccaattagcgtgaccacttccatcttaaaaacaaacctaaaaaacaaaatttattatatatatatatatatatatataaaggactgtgggttgtatacaaactattgcaaacacttgtgcaaatctgtcttgatataaaggaaaagcaaaatctgtataacattattactacttgaatgcctctgtgactgatttttttttcattttaaatataaacttttttgtgaaaagtatgctcaatgttttttttccctttccccattcccttgtaaatacattttgttctatgtgacttggtttggaaatagttaactggtactgtaatttgcattaaataaaaagtaggttagcctggaaatgaaattaaaaaaaaaaaaaaaaaa

SEQ ID NO: 37 - protein, 433 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKDSSGTGHFTSGVRVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 38 - DNA, 7134 bp, Homo sapiens
cgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcgaggagccgctgcctggggtctgaagggagctgcctccgccaccgccatggccgctggatccagccgccgcctgcagctgctcctggcgcaatgaggagaggagccgccgccaccgccaccgcccgcctctgactgactcgcgactccgccgccctctagttcgccgggcccctgccgtcagcccgccggatcccgcggcttgccggagctgcagcgtttcccgtcgcatctccgagccaccccctccctccctctccctccctcctacccatccccctttctcttcaagcgtgagactcgtgatccttccgccgcttcccttcttcattgactcggaaaaaaaatccccgaggaaaatataatattcgaagtactcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggattcgtcaggaacaggacatttcacctcaggagtgcgggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaaatcctgttcattttagtgttcaatttttttattattattgttgttcttatttaaccttgtaaaatatctataaatacaaaccaatttcattgtattctcactttgagggagatccagggggtgggaggggttgtggggagggggaaagcggagcactagaacatacaatctctctcccacgacaatctttttttattaaaagtctgctgttgtatactttaaaaacaggactcctgcctcatgccccttccacaaaagaagaaaacctttttctgtgctgatgggtttttttgaactttgttttcttttaaagtctagtgtgagactttggtatagtgcacagcttgaaattggttgggagcttagcaggtataactcaacggggacttaaatgtcacttgtaaaattaatccatatcttcgggtatttatagacttgcctttggcatgttggtggcaggtgtggcagacaaagaaatgtgtatcattcgtaacccagggaggtcaataaagtttggaactctacagggaagattcttagtagatttgttaaggttttgttttgctctcagttagtgctagtgatgtagaggcttgtacaggaggctgccagaggggaagcagcaagcaagactcaggcacacatgctctacaggtggctctttgtttgcctgaccaaagttctttgcaaatcttagcacagtttcaaactagtgacctgggaggagatggaaggggtgttgagcaggctgagctagctgctgaggtcaaaggctgatgagcccagaggaaggggacaggtcagggatacatctcaccactgtgaataagtttgtccagatttttttctaaagttacttcccttggaaagatacacttgagaggacattgtagttaaataatgtgaactgtaacagtcatctactggtttatttttcatattttttaattgaaaattgagcttgcagaaatagccacattctacacatagttctaattttaaatccaaatctagaatctgtatttaatttgttttttaacctcatgctttttacatttatttattgatgcatgtcagatggtagaaatattaaaaactacacatcagaatgatacagtcacttatacctgctgactttataggaaagctgatgatataaatgtgtgtatatatgttatatatacatatattcaatactgcctttttttttgtctacagtatcaaaattgactggttgaagcatgagaagaatgtttcccccacacccagttaagagtttttgtgtctgttttctttgtgtatcagtgaacgatgttaagaatcagtctctctttttgaagaaaaagcaatattccttggaaagcaaggagaattgaaggactatgtttgccgtgaggaaatagattttcatgactagtttgttttatacttttaaggttggcatctatgtgggccttatatactctaaaatgaactttagtcaccttggtgcttatgggccattacttgacctatgaatctttaaggcacaatcagttgtactttacatttaaagatcacttgagtgatggccgcctttccctcctacccgctccttccccacatgccttccaaggttagctggtaactgtagggctgcagagctgagcccatggttgtgtgtaacttgccctcaccctcctcattgccaccttaggtcactttatgggtctcgtcctccagagggttcggaagtggagtctgttggcagccctcctgcaggccctagcaccctgtcctgctccttaactgtgtgtgtgactctccaagagagttgtcctgcctgctgaagtgaaccagtacccagaaagacaactgtgagccatcttggttttcactcgctgtttagctgaggtcttgggccacaaaaggggtttcacaaacctctggatatatcagagtttatgagaaaggaaacatgctcagtcaaaccaaatcaaacaaattgaattttatgttttataaagtgcttctgaaagctaagatttgaaagaagtctgaaatcaaagtatttggcagcataactccttaaaggtagtggcgttgatagaccattttcagacagaatttataaagaatctgaaaaggcaggtctgtgatagagaaatggacctgcattcagatccaactgcccagcaagcgtttggatgcagacactgctctggacgtggtatactccccagagtccataaaaatcagtgcttattttaggaaacaggttgccccccacaactggggtaaaagaagagagaaaagtcacgcttttctctcatttcattgtgtgtgcatgtgtgcgtgtgtgtgtgtgtgtgtgtgtgctgagatgtgtgatttttctttctcaaggatcatggtgggatcacagaactcttttatacaagtgagatccaggtctctgaatatctttttgtatataataataataaaaagctcctcaccaaattcaagcttgtacattatattttctttctgtgtttttaaatttaagttttattgttttgtatgtaaatatgtggacccaggaactgttattaatgagcaaaaagttactgttcagggcagtgattctgtttaataatcagacaaaatgtagacgagctttttaaagccatatagttttaactctgtacagtaggtaccggcctgtattattgtaacaataactctagcaatgtatagtgtatctatatagtttggagtgccttcgcttccatgtgtttttttttttaatttgttcttttttaaattttaattggtttcctttatccatgtctccctgtccaccccctttccctttgaaataataactcactcataacagtatctttgccccttccacagttaagtttcagtgataccatactcaggagtgggaagaggaaatcatattcgtaatttcatttcgttgaagccctgcctttgttttggttctgaatgtctttcctcctcggtagcagtgagaccggtttcatttcatacttagtccattcagggacttagtgtagcaccagggagccctagagctggaggatatcgaatagattaaattttgctcgtctcttccacaagccctaaccatgggtcttaaaaacagcagattctgggagccttccatgctctctctctctcctcttttatctacttccctcccaaatgagagagtgacagagaattgtttttttataaatcgaagtttcttaatagtatcaggttttgatacgtcagtggtctaaaatgctatagtgcaattactagcagttactgcacggagtgccaccgtgccaatagaggactgttgttttaacaagggaactcttagcccatttcctccctcccgccatctctacccttgctcaatgaaatatcattttaatttcttttaaaaaaaatcagtttaattcttactgtgtgcccaacacgaaggccttttttgaaagaaaaatagaatgttttgcctcaaagtagtccatataaaatgtcttgaatagaagaaaaaactaccaaaccaaaggttactatttttgaaacatcgtgtgttcattccagcaaggcagaagactgcaccttctttccagtgacatgctgtgtcattttttttaagtcctcttaatttttagacacatttttggtttatgttttaacaatgtatgcctaaccagtcatcttgtctgcaccaatgcaaaggtttctgagaggagtattctctatccctgtggatatgaagacactggcatttcatctatttttccctttcctttttaaaggatttaactttggaatcttccaaaggaagtttggccaatgccagatccccaggaatttggggggttttctttcttttcaactgaaattgtatctgattcctactgttcatgttagtgatcatctaatcacagagccaaacacttttctcccctgtgtggaaaagtaggtatgctttacaataaaatctgtcttttctggtagaaacctgagccactgaaaataaaagagacaactagaagcacagtagagtcccagactgagatctacctttgagaggctttgaaagtaatccctggggtttggattattttcacaagggttatgccgttttattcaagtttgttgctccgttttgcacctctgcaataaaagcaaaatgacaaccagtacataaggggttagcttgacaaagtagacttccttgtgttaatttttaagtttttttttccttaactatatctgtctacaggcagatacagatagttgtatgaaaatctgcttgcctgtaaaatttgcatttataaatgtgttgccgatggatcacttgggcctgtacacataccaattagcgtgaccacttccatcttaaaaacaaacctaaaaaacaaaatttattatatatatatatatatatatataaaggactgtgggttgtatacaaactattgcaaacacttgtgcaaatctgtcttgatataaaggaaaagcaaaatctgtataacattattactacttgaatgcctctgtgactgatttttttttcattttaaatataaacttttttgtgaaaagtatgctcaatgttttttttccctttccccattcccttgtaaatacattttgttctatgtgacttggtttggaaatagttaactggtactgtaatttgcattaaataaaaagtaggttagcctggaaatgaaattaaaaaaaaaaaaaaaaaa

SEQ ID NO: 39 - protein, 1235 aa, Homo sapiens
MHLAERDRWLFVATVMMHFVSIKSGFPGLCVGVRSTMSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAVERLEVEKAFHPFIAGPYNRLVGEIMQETGTRINIPPPSVNRTEIVFTGEKEQLAQAVARIKKIYEEKANSFTVSSVAAPSWLHRFIIGKKGQNLAKITQQMPKVHIEFTEGEDKITLEGPTEDVNVAQEQIEGMVKDLINRMDYVEINIDHKFHRHLIGKSGANINRIKDQYKVSVRIPPDSEKSNLIRIEGDPQGVQQAKRELLELASRMENERTKDLIIEQRFHRTIIGQKGERIREIRDKFPEVIINFPDPAQKSDIVQLRGPKNEVEKCTKYMQKMVADLVENSYSISVPIFKQFHKNIIGKGGANIKKIREESNTKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKQTKSFTVDIRAKPEYHKFLIGKGGGKIRKVRDSTGARVIFPAAEDKDQDLITIIGKEDAVREAQKELEALIQNLDNVVEDSMLVDPKHHRHFVIRRGQVLREIAEEYGGVMVSFPRSGTQSDKVTLKGAKDCVEAAKKRIQEIIEDLEAQVTLECAIPQKFHRSVMGPKGSRIQQITRDFSVQIKFPDREENAVHSTEPVVQENGDEAGEGREAKDCDPGSPRRCDIIIISGRKEKCEAAKEALEALVPVTIEVEVPFDLHRYVIGQKGSGIRKMMDEFEVNIHVPAPELQSDIIAITGLAANLDRAKAGLLERVKELQAEQEDRALRSFKLSVTVDPKYHPKIIGRKGAVITQIRLEHDVNIQFPDKDDGNQPQDQITITGYEKNTEAARDAILRIVGELEQMVSEDVPLDHRVHARIIGARGKAIRKIMDEFKVDIRFPQSGAPDPNCVTVTGLPENVEEAIDHILNLEEEYLADVVDSEALQVYMKPPAHEEAKAPSRGFVVRDAPWTASSSEKAPDMSSSEEFPSFGAQVAPKTLPWGPKR

SEQ ID NO: 40 - DNA, 6291 bp, Homo sapiens
ggagcgtcccggcttctcccgcgcggggggcgagtaagccagcggcaggaccagcgggcgggggcccacgacaaaagctggcaggctgacagaggcggcctcaggacggaccttctggctactgaccgttttgctgctaccacttataaccacctggttaagtcgagatttggaggtggtttagtttggggcctggatgcaccttgcagagagagaccgctggctttttgtagcaactgtcatgatgcattttgtaagcattaagagtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcaatggacagcaggaggcaggttcctggagctggggggtgacctgagaggcagagggtgacgggttctcaggcagtcctgattttacctgccgtggggtctgaaagcaccaagggtccctgcccctacctccactgccagaccctcagcctgaggtctggtgagtggagcctggaggcaaggtggtaggcaccatctgggtcccctgtggccgtcacagtgtctgctgtgattgagatgcgcacaggttgggggaggtagggccttacgcttgtcctcagtgggggcagtttgccttagatgacagctgggctcttcttcacaccacctgcagcccctccctgcccctgccctagctgctgtgtgttcagttgccttctttctacctcagccggcgtggagtggtctctgtgcagttagtgccaccccacacacccgtctcttgattgagatgtttctggtggttatgggtttcccgtggagctgggggtgggcgccgtgtacctaagctggaggctggcgctctccctcagcacaggtgggtcagtggccagcaggcccatctggagtgggagtgggcacttccaccccgcccacaggccatccggctgtgcaggccagcccctaggagcaggtcccgggtgactggcagttttcacggtctagggccgagacgatggcatggggcctagagcatgaggtagagcagaatgcagaccacgccgctggatgccgagagaccctgctctccgagggaggcatctgtgtcatgctgtgagggctgaggacggggccctagtctctggttttctggtcttaacatccttatctgtgtccgccacggaggtgactgagctgctagcgagttgtcctgtcccaggtacttgagttttggaaaagctgactcacgcccatccatctcacagcccttccctggggacagtcgcttccgccttgacacctcactctcagttgaataactcaagcttggtcatcttcagactcgaattcttgagtagacccagacggcttagcccaagtctagttgcagctgcctcggcaagtccccatttgctcaggcagccctgaatgggcctgtttacaggaatggtaaattgggattggaaggaatatagcttccagcttcataggctagggtgaccacggcttaggaaacagggaaagaaagcaaggcccttttcctgcctttcccgggatctgtctactccacctccacgggggaggccagtggggaagggctgtcacctcttccccatctgcatgagttctggaactctgtcctgttggctgcttgcttccagctccccccaatctccatcgcagcgggttcctcctgtcttttctacagtgtcataaaacatcctgcccctaccctctcccaaaggtcaattttaattctcaccaagttttgcacatctctgtatgtcgcttgatgtcttagacgcgagccctttcctaaactgttcagcgctctcttttcctttgggtggttgttgcaagggtgatgacatgactgtccccaggcctgtctccctgaagcgtctgtgctgtcaggacagccctgggcagagatgaggcaggggtgaggcgtgcgtgtgcttttcctccttgttggatgtcttccatatcatctgtttccatagctacaatccatcccttggccttaactttggaatttggagattatatgcaaacatgtgtaaaggctcatgaatatggatgacactggaattttataaattctaaaataaaacccgaaaccagatgtagcatgctgggactcattttgaaaaaaaaaaaaaaaaaaaaaaaaaaaaaaaaaaaaaaaaaaaaaaaaaaaaa

SEQ ID NO: 41 - protein, 1268 aa, Homo sapiens
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAVERLEVEKAFHPFIAGPYNRLVGEIMQETGTRINIPPPSVNRTEIVFTGEKEQLAQAVARIKKIYEEKKKKTTTIAVEVKKSQHKYVIGPKGNSLQEILERTGVSVEIPPSDSISETVILRGEPEKLGQALTEVYAKANSFTVSSVAAPSWLHRFIIGKKGQNLAKITQQMPKVHIEFTEGEDKITLEGPTEDVNVAQEQIEGMVKDLINRMDYVEINIDHKFHRHLIGKSGANINRIKDQYKVSVRIPPDSEKSNLIRIEGDPQGVQQAKRELLELASRMENERTKDLIIEQRFHRTIIGQKGERIREIRDKFPEVIINFPDPAQKSDIVQLRGPKNEVEKCTKYMQKMVADLVENSYSISVPIFKQFHKNIIGKGGANIKKIREESNTKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKQTKSFTVDIRAKPEYHKFLIGKGGGKIRKVRDSTGARVIFPAAEDKDQDLITIIGKEDAVREAQKELEALIQNLDNVVEDSMLVDPKHHRHFVIRRGQVLREIAEEYGGVMVSFPRSGTQSDKVTLKGAKDCVEAAKKRIQEIIEDLEAQVTLECAIPQKFHRSVMGPKGSRIQQITRDFSVQIKFPDREENAVHSTEPVVQENGDEAGEGREAKDCDPGSPRRCDIIIISGRKEKCEAAKEALEALVPVTIEVEVPFDLHRYVIGQKGSGIRKMMDEFEVNIHVPAPELQSDIIAITGLAANLDRAKAGLLERVKELQAEQEDRALRSFKLSVTVDPKYHPKIIGRKGAVITQIRLEHDVNIQFPDKDDGNQPQDQITITGYEKNTEAARDAILRIVGELEQMVSEDVPLDHRVHARIIGARGKAIRKIMDEFKVDIRFPQSGAPDPNCVTVTGLPENVEEAIDHILNLEEEYLADVVDSEALQVYMKPPAHEEAKAPSRGFVVRDAPWTASSSEKAPDMSSSEEFPSFGAQVAPKTLPWGPKR

SEQ ID NO: 42 - DNA, 6427 bp, Homo sapiens
atagaggctgggggtggggggggaggtcaagcgtagcctcttctcctttaccaagatggcggcttgtccctgtttcgccacagttcctaccttatgagctcggttttcttatgcttataagagtggaacagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcaatggacagcaggaggcaggttcctggagctggggggtgacctgagaggcagagggtgacgggttctcaggcagtcctgattttacctgccgtggggtctgaaagcaccaagggtccctgcccctacctccactgccagaccctcagcctgaggtctggtgagtggagcctggaggcaaggtggtaggcaccatctgggtcccctgtggccgtcacagtgtctgctgtgattgagatgcgcacaggttgggggaggtagggccttacgcttgtcctcagtgggggcagtttgccttagatgacagctgggctcttcttcacaccacctgcagcccctccctgcccctgccctagctgctgtgtgttcagttgccttctttctacctcagccggcgtggagtggtctctgtgcagttagtgccaccccacacacccgtctcttgattgagatgtttctggtggttatgggtttcccgtggagctgggggtgggcgccgtgtacctaagctggaggctggcgctctccctcagcacaggtgggtcagtggccagcaggcccatctggagtgggagtgggcacttccaccccgcccacaggccatccggctgtgcaggccagcccctaggagcaggtcccgggtgactggcagttttcacggtctagggccgagacgatggcatggggcctagagcatgaggtagagcagaatgcagaccacgccgctggatgccgagagaccctgctctccgagggaggcatctgtgtcatgctgtgagggctgaggacggggccctagtctctggttttctggtcttaacatccttatctgtgtccgccacggaggtgactgagctgctagcgagttgtcctgtcccaggtacttgagttttggaaaagctgactcacgcccatccatctcacagcccttccctggggacagtcgcttccgccttgacacctcactctcagttgaataactcaagcttggtcatcttcagactcgaattcttgagtagacccagacggcttagcccaagtctagttgcagctgcctcggcaagtccccatttgctcaggcagccctgaatgggcctgtttacaggaatggtaaattgggattggaaggaatatagcttccagcttcataggctagggtgaccacggcttaggaaacagggaaagaaagcaaggcccttttcctgcctttcccgggatctgtctactccacctccacgggggaggccagtggggaagggctgtcacctcttccccatctgcatgagttctggaactctgtcctgttggctgcttgcttccagctccccccaatctccatcgcagcgggttcctcctgtcttttctacagtgtcataaaacatcctgcccctaccctctcccaaaggtcaattttaattctcaccaagttttgcacatctctgtatgtcgcttgatgtcttagacgcgagccctttcctaaactgttcagcgctctcttttcctttgggtggttgttgcaagggtgatgacatgactgtccccaggcctgtctccctgaagcgtctgtgctgtcaggacagccctgggcagagatgaggcaggggtgaggcgtgcgtgtgcttttcctccttgttggatgtcttccatatcatctgtttccatagctacaatccatcccttggccttaactttggaatttggagattatatgcaaacatgtgtaaaggctcatgaatatggatgacactggaattttataaattctaaaataaaacccgaaaccagatgtagcatgctgggactcattttgaaaaaaaaaaaaaaaaaaaaaaaaaaaaaaaaaaaaaaaaaaaaaaaaaaaaa

SEQ ID NO: 43 - protein, 1268 aa, Homo sapiens; identical to SEQ ID NO: 41

SEQ ID NO: 44 - DNA, 6367 bp, Homo sapiens
ggagcgtcccggcttctcccgcgcggggggcgagtaagccagcggcaggaccagcgggcgggggcccacgacaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggccaatagcttcaccgtctcctctgtcgccgccccttcctggcttcaccgtttcatcattggcaagaaagggcagaacctggccaaaatcactcagcagatgccaaaggttcacatcgagttcacagagggcgaagacaagatcaccctggagggccctacagaggatgtcaatgtggcccaggaacagatagaaggcatggtcaaagatttgattaaccggatggactatgtggagatcaacatcgaccacaagttccacaggcacctcattgggaagagcggtgccaacataaacagaatcaaagaccagtacaaggtgtccgtgcgcatccctcctgacagtgagaagagcaatttgatccgcatcgagggggacccacagggcgtgcagcaggccaagcgagagctgctggagcttgcatctcgcatggaaaatgagcgtaccaaggatctaatcattgagcaaagatttcatcgcacaatcattgggcagaagggtgaacggatccgtgaaattcgtgacaaattcccagaggtcatcattaactttccagacccagcacaaaaaagtgacattgtccagctcagaggacctaagaatgaggtggaaaaatgcacaaaatacatgcagaagatggtggcagatctggtggaaaatagctattcaatttctgttccgatcttcaaacagtttcacaagaatatcattgggaaaggaggcgcaaacattaaaaagattcgtgaagaaagcaacaccaaaatcgaccttccagcagagaatagcaattcagagaccattatcatcacaggcaagcgagccaactgcgaagctgcccggagcaggattctgtctattcagaaagacctggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggaagctcaggtgacattagaatgtgctataccccagaaattccatcgatctgtcatgggccccaaaggttccagaatccagcagattactcgggatttcagtgttcaaattaaattcccagacagagaggagaacgcagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggcattggttcctgtcaccattgaagtagaggtgccctttgaccttcaccgttacgttattgggcagaaaggaagtgggatccgcaagatgatggatgagtttgaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggctttaaggagttttaagctgagtgtcactgtagaccccaaataccatcccaagattatcgggagaaagggggcagtaattacccaaatccggttggagcatgacgtgaacatccagtttcctgataaggacgatgggaaccagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaacccccagcacacgaagaggccaaggcaccttccagaggctttgtggtgcgggacgcaccctggaccgccagcagcagtgagaaggctcctgacatgagcagctctgaggaatttcccagctttggggctcaggtggctcccaagaccctcccttggggccccaaacgataatgatcaaaaagaacagaaccctctccagcctgctgacccaaacccaaccacacaatggtttgtctcaatctgacccagcggctggaccctccgtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcaatggacagcaggaggcaggttcctggagctggggggtgacctgagaggcagagggtgacgggttctcaggcagtcctgattttacctgccgtggggtctgaaagcaccaagggtccctgcccctacctccactgccagaccctcagcctgaggtctggtgagtggagcctggaggcaaggtggtaggcaccatctgggtcccctgtggccgtcacagtgtctgctgtgattgagatgcgcacaggttgggggaggtagggccttacgcttgtcctcagtgggggcagtttgccttagatgacagctgggctcttcttcacaccacctgcagcccctccctgcccctgccctagctgctgtgtgttcagttgccttctttctacctcagccggcgtggagtggtctctgtgcagttagtgccaccccacacacccgtctcttgattgagatgtttctggtggttatgggtttcccgtggagctgggggtgggcgccgtgtacctaagctggaggctggcgctctccctcagcacaggtgggtcagtggccagcaggcccatctggagtgggagtgggcacttccaccccgcccacaggccatccggctgtgcaggccagcccctaggagcaggtcccgggtgactggcagttttcacggtctagggccgagacgatggcatggggcctagagcatgaggtagagcagaatgcagaccacgccgctggatgccgagagaccctgctctccgagggaggcatctgtgtcatgctgtgagggctgaggacggggccctagtctctggttttctggtcttaacatccttatctgtgtccgccacggaggtgactgagctgctagcgagttgtcctgtcccaggtacttgagttttggaaaagctgactcacgcccatccatctcacagcccttccctggggacagtcgcttccgccttgacacctcactctcagttgaataactcaagcttggtcatcttcagactcgaattcttgagtagacccagacggcttagcccaagtctagttgcagctgcctcggcaagtccccatttgctcaggcagccctgaatgggcctgtttacaggaatggtaaattgggattggaaggaatatagcttccagcttcataggctagggtgaccacggcttaggaaacagggaaagaaagcaaggcccttttcctgcctttcccgggatctgtctactccacctccacgggggaggccagtggggaagggctgtcacctcttccccatctgcatgagttctggaactctgtcctgttggctgcttgcttccagctccccccaatctccatcgcagcgggttcctcctgtcttttctacagtgtcataaaacatcctgcccctaccctctcccaaaggtcaattttaattctcaccaagttttgcacatctctgtatgtcgcttgatgtcttagacgcgagccctttcctaaactgttcagcgctctcttttcctttgggtggttgttgcaagggtgatgacatgactgtccccaggcctgtctccctgaagcgtctgtgctgtcaggacagccctgggcagagatgaggcaggggtgaggcgtgcgtgtgcttttcctccttgttggatgtcttccatatcatctgtttccatagctacaatccatcccttggccttaactttggaatttggagattatatgcaaacatgtgtaaaggctcatgaatatggatgacactggaattttataaattctaaaataaaacccgaaaccagatgtagcatgctgggactcattttgaaaaaaaaaaaaaaaaaaaaaaaaaaaaaaaaaaaaaaaaaaaaaaaaaaaaa

SEQ ID NO: 45 - protein, 127 aa, Homo sapiens
MPEVSSKGATISKKGFKKAVVKTQKKEGKKRKRTRKESYSIYIYKVLKQVHPDTGISSKAMSIMNSFVTDIFERIASEASRLAHYSKRSTISSREIQTAVRLLLPGELAKHAVSEGTKAVTKYTSSK

SEQ ID NO: 46 - DNA, 437 bp, Homo sapiens
atgccggaggtgtcatctaaaggtgctaccatttccaagaagggctttaagaaagctgtcgttaagacccagaaaaaggaaggcaaaaagcgcaagaggacccgtaaggagagttattctatttacatctacaaagtgctaaagcaggtccatccggacactggcatctcttcgaaagctatgagcattatgaattccttcgtcactgatatctttgagcgtatagcgagcgaggcatcacgtttggctcactacagcaagcgctccaccatttcttccagagagattcagacagcagtgcgcttgctactgccgggagagctggctaaacatgctgtgtctgagggcaccaaggctgtcactaagtacaccagctccaagtaagcctgctaagtaaacgtcatttctaacccaaaggctcttttcagagccactta

SEQ ID NO: 47 - protein, 209 aa, Homo sapiens
MGKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEKDIAAYRAKGKSEAGKKGPGRPTGSKKKNEPEDEEEEEEEEDEDEEEEDEDEE

SEQ ID NO: 48 - DNA, 1467 bp, Homo sapiens
aaaccagttcacgccggagccccgtgagggaagcgtctccgttgggtccggccgctctgcgggactctgaggaaaagctcgcaccaggcaagaataccctccaataccctcgggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttcactttaaaaaagccatttgaagaccagagctatgttgatttttttcggtatttctgcctagtagttcttagacacagttgacctagtaaaatgtttgagaattaaaaccaaacatgctcatatttgcaaaatgttctttaaaagttacatgttgaactcagtgaactttataagaatttatgcagttttacagaacgttaagttttgtacttgacgtttctgtttattagctaaattgttcctcaggtgtgtgtatatatatatacatatatatatatatatatat

SEQ ID NO: 49 - protein, 209 aa, Homo sapiens; identical to SEQ ID NO: 47

SEQ ID NO: 50 - DNA, 1454 bp, Homo sapiens
ggatttgggcgggaagcggagccccgccagcgcccgccctggcagctgcgggctccgcgccgaccctccggcttcccctctcccccctcggccccgtcaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttcactttaaaaaagccatttgaagaccagagctatgttgatttttttcggtatttctgcctagtagttcttagacacagttgacctagtaaaatgtttgagaattaaaaccaaacatgctcatatttgcaaaatgttctttaaaagttacatgttgaactcagtgaactttataagaatttatgcagttttacagaacgttaagttttgtacttgacgtttctgtttattagctaaattgttcctcaggtgtgtgtatatatatatacatatatatatatatatatat

SEQ ID NO: 51 - protein, 209 aa, Homo sapiens; identical to SEQ ID NO: 47

SEQ ID NO: 52 - DNA, 1527 bp, Homo sapiens
ggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttcactttaaaaaagccatttgaagaccagagctatgttgatttttttcggtatttctgcctagtagttcttagacacagttgacctagtaaaatgtttgagaattaaaaccaaacatgctcatatttgcaaaatgttctttaaaagttacatgttgaactcagtgaactttataagaatttatgcagttttacagaacgttaagttttgtacttgacgtttctgtttattagctaaattgttcctcaggtgtgtgtatatatatatacatatatatatatatatatat

SEQ ID NO: 53 - protein, 464 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYADVEGF

SEQ ID NO: 54 - DNA, 2995 bp, Homo sapiens
ccctagccgcccctccccccagctagtgagtgcgcgaacgagaaaggaggagggcgctccaggcgacagcactgcagacgccattatcctctgtttctctgctgcaccgacctcgacgtcttgcctgtgtcccacttgttcgcggcctataggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgtaaaaaaaaaaaaaaaaaa

SEQ ID NO: 55 - protein, 463 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIGEILKKIIPTLEEGLQLPSPTATSQLPLESDAVECLNYQHYKGSDFDCELRLLIHQSLAGGIIGVKGAKIKELRENTQTTIKLFQECCPHSTDRVVLIGGKPDRVVECIKIILDLISESPIKGRAQPYDPNFYDETYDYGGFTMMFDDRRGRPVGFPMRGRGGFDRMPPGRGGRPMPPSRRDYDDMSPRRGPPPPPPGRGGRGGSRARNLPLPPPPPPRGGDLMAYDRRGRPGDRYDGMVGFSADETWDSAIDTWSPSEWQMAYEPQGGSGYDYSYAGGRGSYGDLGGPIITTQVTIPKDLAGSIIGKGGQRIKQIRHESGASIKIDEPLEGSEDRIITITGTQDQIQNAQYLLQNSVKQYSGKFF

SEQ ID NO: 56 - DNA, 2935 bp, Homo sapiens
ccctagccgcccctccccccagctagtgagtgcgcgaacgagaaaggaggagggcgctccaggcgacagcactgcagacgccattatcctctgtttctctgctgcaccgacctcgacgtcttgcctgtgtcccacttgttcgcggcctataggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgtaaaaaaaaaaaaaaaaaa

SEQ ID NO: 57 - protein, 464 aa, Homo sapiens; identical to SEQ ID NO: 53

SEQ ID NO: 58 - DNA, 2960 bp, Homo sapiens
tagggcgcgacggcggggaggacgcgagaaggcgggggaggggagcctgcgctcgttttctgtctagctccgaccggctgaggcggcgcggcagcggagggacggcagtctcgcgcggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgtaaaaaaaaaaaaaaaaaa

SEQ ID NO: 59 - protein, 363 aa, Homo sapiens
MEVPPRLSHVPPPLFPSAPATLASRSLSHWRPRPPRQLAPLLPSLAPSSARQGARRAQRHVTAQQPSRLAGGAAIKGGRRRRPDLFRRHFKSSSIQRSAAAAAATRTARQHPPADSSVTMEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQQSTYGKASRGGGNHQNNYQPY

SEQ ID NO: 60 - DNA, 3986 bp, Homo sapiens
gaggccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaatccaaacttttaatcaagtcttgatatgtatgactgagaaaaaatacactacatctagagatgattgagatgttttgcaaagaattgaagggggagtgagaattggtttttcttgcaggggctttgaactctagatttgggctttgaactctagatttaattcagatttcagggtctatcagttcaccaactgatgcaaatttgaacagatactctaaggctaagtgtcctaggttggatgaactgaagctactatcaagatctcgttcccaaggattaatttagaacaaagtaattggacaagtttattggggaggggatagaaatgaattctaaagtacctataacaaatactctgtgtatgttttttacatcgtatttgccttttacattgtttagaccaaattctgtgtgatgttatcctcgggaagaggatagaaattaattctaaagtacctataacaaatgctcggtttgtatatgtttttatacatcgtatttgccttttgcattgttcagaccaaattctgtgtgatgttatcctaacaaaacaccttagtaatttctttggttaacatgttaatctgtaatctcacttttataagatgaggactattaaaatgagatgtctgttgggatgctaaaaaaaaaaaaaaaaaa

SEQ ID NO: 61 - protein, 420 aa, Homo sapiens
MEVPPRLSHVPPPLFPSAPATLASRSLSHWRPRPPRQLAPLLPSLAPSSARQGARRAQRHVTAQQPSRLAGGAAIKGGRRRRPDLFRRHFKSSSIQRSAAAAAATRTARQHPPADSSVTMEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGQQSTYGKASRGGGNHQNNYQPY

SEQ ID NO: 62 - DNA, 4157 bp, Homo sapiens
gaggccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaaaggagaacattggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaatccaaacttttaatcaagtcttgatatgtatgactgagaaaaaatacactacatctagagatgattgagatgttttgcaaagaattgaagggggagtgagaattggtttttcttgcaggggctttgaactctagatttgggctttgaactctagatttaattcagatttcagggtctatcagttcaccaactgatgcaaatttgaacagatactctaaggctaagtgtcctaggttggatgaactgaagctactatcaagatctcgttcccaaggattaatttagaacaaagtaattggacaagtttattggggaggggatagaaatgaattctaaagtacctataacaaatactctgtgtatgttttttacatcgtatttgccttttacattgtttagaccaaattctgtgtgatgttatcctcgggaagaggatagaaattaattctaaagtacctataacaaatgctcggtttgtatatgtttttatacatcgtatttgccttttgcattgttcagaccaaattctgtgtgatgttatcctaacaaaacaccttagtaatttctttggttaacatgttaatctgtaatctcacttttataagatgaggactattaaaatgagatgtctgttgggatgctaaaaaaaaaaaaaaaaaa

SEQ ID NO: 63 - protein, 679 aa, Homo sapiens
MISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 64 - DNA, 3506 bp, Homo sapiens
ttcctcccctggactctttctgagctcagagccgccgcagccgggacaggagggcaggctttctccaaccatcatgctgcggagcatattacctgtacgccctggctccgggagcggcagtcgagtatcctctggtcaggcggcgcgggcggcgcctcagcggaagagcgggcctctgggccgcagtgaccaacccccgcccctcaccccacgtggttggaggtttccagaagcgctgccgccaccgcatcgcgcagctctttgccgtcggagcgcttgtttgctgcctcgtactcctccatttatccgccatgataagtgccagccgagctgcagcagcccgtctcgtgggcgccgcagcctcccggggccctacggccgcccgccaccaggatagctggaatggccttagtcatgaggcttttagacttgtttcaaggcgggattatgcatcagaagcaatcaagggagcagttgttggtattgatttgggtactaccaactcctgcgtggcagttatggaaggtaaacaagcaaaggtgctggagaatgccgaaggtgccagaaccaccccttcagttgtggcctttacagcagatggtgagcgacttgttggaatgccggccaagcgacaggctgtcaccaacccaaacaatacattttatgctaccaagcgtctcattggccggcgatatgatgatcctgaagtacagaaagacattaaaaatgttccctttaaaattgtccgtgcctccaatggtgatgcctgggttgaggctcatgggaaattgtattctccgagtcagattggagcatttgtgttgatgaagatgaaagagactgcagaaaattacttggggcacacagcaaaaaatgctgtgatcacagtcccagcttatttcaatgactcgcagagacaggccactaaagatgctggccagatatctggactgaatgtgcttcgggtgattaatgagcccacagctgctgctcttgcctatggtctagacaaatcagaagacaaagtcattgctgtatatgatttaggtggtggaacttttgatatttctatcctggaaattcagaaaggagtatttgaggtgaaatccacaaatggggataccttcttaggtggggaagactttgaccaggccttgctacggcacattgtgaaggagttcaagagagagacaggggttgatttgactaaagacaacatggcacttcagagggtacgggaagctgctgaaaaggctaaatgtgaactctcctcatctgtgcagactgacatcaatttgccctatcttacaatggattcttctggacccaagcatttgaatatgaagttgacccgtgctcaatttgaagggattgtcactgatctaatcagaaggactatcgctccatgccaaaaagctatgcaagatgcagaagtcagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtctctgggtattgaaactctaggaggtgtctttaccaaacttattaataggaataccactattccaaccaagaagagccaggtattctctactgccgctgatggtcaaacgcaagtggaaattaaagtgtgtcagggtgaaagagagatggctggagacaacaaactccttggacagtttactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcactgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatctcttgtttgtgaggggtgatgccctgagatttagcttcaagaatatgccatggctcatgcttcccatatttcccaaagagggaaatacaggatttgctaacactggttaaaaatgcaaattcaagatttggaagggctgttataatgaaataatgagcagtatcagcatgtgcaaatcttgtttgaaggattttattttctccccttagacctttggtacatttagaatcttgaaagtttctagatctctaacatgaaagtttctagatctctaacatgaaagtttttagatctctaacatgaaaaccaaggtggctattttcaggttgctttcagctccaagtagaaataaccagaattggcttacattaaagaaactgcatctagaaataagtcctaagatactatttctatggctcaaaaataaaaggaacccagatttctttcccta

SEQ ID NO: 65 - protein, 400 aa, Homo sapiens [sequence omitted]

SEQ ID NO: 66 - DNA, 1759 bp, Homo sapiens
cccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaaaaaaaaaaaaaaaaaaaa

SEQ ID NO: 67 - protein, 274 aa, Homo sapiens
MATLKDQLIYNLLKEEQTPQNKITVVGVGAVGMACAISILMKDLADELALVDVIEDKLKGEMMDLQHGSLFLRTPKIVSGKVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 68 - DNA, 2052 bp, Homo sapiens
gtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggaaaaaaaaaaaaaaaaaa

SEQ ID NO: 69 - protein, 361 aa, Homo sapiens
MGEPSGGYTYTQTSIFLFHAKIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 70 - DNA, 2323 bp, Homo sapiens
ttgggcggggcgtaaaagccgggcgttcggaggacccagcaattagtctgatttccgcccacctttccgagcgggaaggagagccacaaagcgcgcatgcgcgcggatcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggaaaaaaaaaaaaaaaaaa

SEQ ID NO: 71 - protein, 274 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKECRYTLGDPKGAAILKSSDVISFHCLGYNRILGGGCACCPFYLICD

SEQ ID NO: 72 - DNA, 1957 bp, Homo sapiens
gtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggaaaaaaaaaaaaaaaaaa

SEQ ID NO: 73 - protein, 241 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVERVFTE

SEQ ID NO: 74 - DNA, 2102 bp, Homo sapiens
gtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggaaaaaaaaaaaaaaaaaa

SEQ ID NO: 75 - protein, 332 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 76 - DNA, 2226 bp, Homo sapiens
gtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggaaaaaaaaaaaaaaaaaa

SEQ ID NO: 77 - protein, 1135 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKIETYRLTFRANARARTDHGADIVSRPPHFPGGPNSGSRVLGPLSRAVH

SEQ ID NO: 78 - DNA, 6046 bp, Homo sapiens
aggccccacccgctggtggcccggtccgcgtgtgcgccgactctcgcactctcctcgctccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcacgcagaaaaaaaaaa

SEQ ID NO: 79 - protein, 1152 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 80 - DNA, 6337 bp, Homo sapiens
aggccccacccgctggtggcccggtccgcgtgtgcgccgactctcgcactctcctcgctccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccgtcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatcacgcagaaaaaaaaaa

SEQ ID NO: 81 - protein, 99 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTEA

SEQ ID NO: 82 - DNA, 3224 bp, Homo sapiens
aggccccacccgctggtggcccggtccgcgtgtgcgccgactctcgcactctcctcgctccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctccaccttactaaaatctaaataatgatagatattttaagtttttaaattgagtagttctgagtaatcctagaatatttttccaaattaaataatcctttattatttgcaagttgggccaaatttttttttttttggagacggactcttaacaatctaagattgtttcaacaggactttcttattcccattcctaattttttcaaactaattgcttaaatctagaaccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgacttccggaatttaggaagcattccctcttctacaggggtctggtcacaagggctggattctctgacaaaaatttcttctatggattctggacagaagacacttgagggtgatatgttttaaaggaaagaggttatgcttatcttcttagcagttgataaaatattaaaactctcttgccatagagaatacaccatcaaagaaaacacaaccctttccctttggtgtacagttatttattaagttgattttggggtttctttcgccagggatcttttcaaaactggtagtagttatttttaaaaatcatgtttgacatctttctattgctcgtaaccagtccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacattaacaccttaaaaaaaaaaaaaaaaaaaa

SEQ ID NO: 83 - protein, 360 aa, Homo sapiens [sequence omitted]

SEQ ID NO: 84 - DNA, 5916 bp, Homo sapiens
gcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttggagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaagtaaactacccaaccacatgccacgtaatatttcagccattcagaggaaactgttttctctttatttgcttatatgttaatatggtttttaaattggtaacttttatatagtatggtaacagtatgttaatacacacatacatacgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatgcgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaa

SEQ ID NO: 85 - protein, 360 aa, Homo sapiens [sequence omitted]

SEQ ID NO: 86 - DNA, 1499 bp, Homo sapiens
gcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggtacctggagtttaatacagtgagctctagcaagggaggcgctgccttttgtttctagaatattatgttcctcaaggtccattattttgtattcttttccaagctccttattggaaggtatttttttaaatttagaattaaaaattatttagaaagttacatataaa

SEQ ID NO: 87 - protein, 332 aa, Homo sapiens
MGAQFSKTAAKGEAAAERPGEAAVASSPSKANGQENGHVKVNGDASPAAAESGAKEELQANGSAPAADKEEPAAAGSGAASPSAAEKGEPAAAAAPEAGASPVEKEAPAEGEAAEPGSPTAAEGEAASAASSTSSPKAEDGATPSPSNETPKKKKKRFSFKKSFKLSGFSFKKNKKEAGEGGEAEAPAAEGGKDEAAGGAAAAAAEAGAASGEQAAAPGEEAAAGEEGAAGGDPQEAKPQEAAVAPEKPPASDETKAAEEPSKVEEKKAEEAGASAAACEAPSAAGPGAPPEQEAAPAEEPAAAAASSACAAPSQEAQPECSPEAPPAEAAE

SEQ ID NO: 88 - DNA, 4304 bp, Homo sapiens
cttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtcttttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcatttttttttttttttttgaaagtgtgttagcatcttgttactcaaaggataagacagacaataatacttcactgaatattaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataatcaaaaaaaaaaaaaaa

SEQ ID NO: 89 - protein, 152 aa, Homo sapiens
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 90 - DNA, 811 bp, Homo sapiens
gcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttct

SEQ ID NO: 91 - protein, 177 aa, Homo sapiens
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 92 - DNA, 1031 bp, Homo sapiens
gcagaagcgttccgtgcgtgcaagtgctgcgaaccacgtgggtcccgggcgcgtttcgggtgctggcggctgcagccggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttct

SEQ ID NO: 93 - protein, 152 aa, Homo sapiens
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 94 - DNA, 867 bp, Homo sapiens
atctcagggcagtaccactgctgtgcggctgtcagtcagtgctgcaggcgccgagaggaggggcttgtgaccgccccagggaagctgggcatcaccaaagggagcttgtttgccagggacactgcaagtaggaagtgtctacaggtcgatgacaggcctaatctctatgacagggtctagactttcctcagggtccaggggcgcacctcagggtgaactggaaaactcgaccgcactttagtgccaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaa

SEQ ID NO: 95 - protein, 152 aa, Homo sapiens; identical to SEQ ID NO: 93

SEQ ID NO: 96 - DNA, 763 bp, Homo sapiens
gcggccgcgcgtggtgggggaggagggaccggcggcgcccacgtggcctccgcgggccccgccagagcctgcgcccgggccctgaccgcacctctcgccccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaaaaaaaaaaaaaaaaaaaaaaaaaaaaaaaaaaaaaaaa

SEQ ID NO: 97 - protein, 152 aa, Homo sapiens; identical to SEQ ID NO: 93

SEQ ID NO: 98 - DNA, 682 bp, Homo sapiens
aggcggtgggggcgcatcccctggcgactcctcccgttccctcttccgcttgcgctgccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaa

SEQ ID NO: 99 - protein, 82 aa, Homo sapiens
MANLERTFIAIKPDGVQRGLVGEIIKRFEQKGFRLVAMKFLRASEEHLKQHYIDLKDRPFFPGLVKYMNSGPVVAMEHHSWQ

SEQ ID NO: 100 - DNA, 733 bp, Homo sapiens
tgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaa

SEQ ID NO: 101 - protein, 152 aa, Homo sapiens; identical to SEQ ID NO: 93

SEQ ID NO: 102 - DNA, 846 bp, Homo sapiens
tgcctggcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggaaaaaaaaaaaaaaaaaa

SEQ ID NO: 103 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 104 - DNA, 2439 bp, Homo sapiens
gagagcagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaaaaaaaaaaaaaaaaaa

SEQ ID NO: 105 - protein, 417 aa, Homo sapiens
MSLSKKLTLDKLDVRGKRVIMRVDFNVPMKKNQITNNQRIKASIPSIKYCLDNGAKAVVLMSHLGRPDGVPMPDKYSLAPVAVELKSLLGKDVLFLKDCVGAEVEKACANPAPGSVILLENLRFHVEEEGKGQDPSGKKIKAEPDKIEAFRASLSKLGDVYVNDAFGTAHRAHSSMVGVNLPHKASGFLMKKELDYFAKALENPVRPFLAILGGAKVADKIQLIKNMLDKVNEMIIGGGMAYTFLKVLNNMEIGASLFDEEGAKIVKDIMAKAQKNGVRITFPVDFVTGDKFDENAQVGKATVASGISPGWMGLDCGPESNKNHAQVVAQARLIVWNGPLGVFEWDAFAKGTKALMDEIVKATSKGCITVIGGGDTATCCAKWNTEDKVSHVSTGGGASLELLEGKILPGVEALSNM

SEQ ID NO: 106 - DNA, 1721 bp, Homo sapiens
aacagtggccgttgtgctggagacagtgaggagaagaaaggggcgggacaagggcaaaggcgttagaagtcaccaccgacccagcccctcaacagcaagttggttcttcagcattaagatccaggtgtcagcctatgtctttatattgtcaagatgtctctttctaagaagttgactttagacaaactggatgttagagggaagcgagtcatcatgagagtagacttcaatgttcccatgaagaagaaccagattacaaacaaccagaggatcaaggcttccatcccaagcatcaagtactgcctggacaatggagccaaggcagtagttcttatgagtcatctaggtcggcctgatggtgttcccatgcctgacaaatattccttagcacctgttgctgttgagctcaaatccttgctgggcaaggatgttctgttcctgaaggactgtgtaggcgcagaagtggagaaagcctgtgccaacccagctcctggttcagtcatcctgctggagaacctgcgctttcatgtggaggaagaagggaagggccaagatccctctggaaagaagattaaagctgagccagataaaatagaagccttccgagcatcactttccaagctaggggacgtctatgtcaatgatgcttttggcactgcacaccgcgctcatagttccatggtgggagtgaatctgccccataaagcatccggattcttgatgaagaaggaactagattactttgctaaagccttggaaaacccagtgagaccctttctggctatacttggtggagccaaagtggcagacaagatccaacttatcaaaaatatgctggacaaagtcaatgagatgattattggtggtggaatggcttataccttccttaaggtactcaacaacatggagattggtgcttccctgtttgatgaagagggagccaagatcgttaaagatatcatggccaaagcacaaaagaatggtgtaaggattacttttcctgttgattttgttactggggacaagtttgacgagaacgctcaggttggaaaagccactgtagcatctggcatatctcctggctggatgggtttggactgtggtcctgagagcaacaagaatcatgctcaagttgtggctcaagcaaggctaattgtttggaatgggccgttaggagtatttgaatgggatgcctttgctaagggaaccaaagccctcatggatgaaattgtgaaagccacttccaagggctgcatcactgttatagggggtggagacactgctacttgctgtgccaaatggaacactgaagataaagtcagccatgtcagcactggaggcggtgccagtctagagcttctggaaggtaaaatccttcctggagtagaggccctcagcaacatgtagttaatatagtgttacttccttctgttttctgtccatggcccttaagtcagcttaatgcttttacatctcgatgtgacttttgttaaaatctactcctagatcaagacctatgtaatggacaagcagcaggccatcaggaactcttaatatcagcacagcaattcattttagtttggtcacgcatttgcctgttcaagttctcatttgaacttcaccattgtgctatctagggaggacatattcttaagttgcctattaaagaaagtgagctgaagaaactgaaaaaaaaaaaaaaaaaaaaaaaaaaaaaaaaa

SEQ ID NO: 107 - protein, 207 aa, Homo sapiens
MTSRKKVLLKVIILGDSGVGKTSLMNQYVNKKFSNQYKATIGADFLTKEVMVDDRLVTMQIWDTAGQERFQSLGVAFYRGADCCVLVFDVTAPNTFKTLDSWRDEFLIQASPRDPENFPFVVLGNKIDLENRQVATKRAQAWCYSKNNIPYFETSAKEAINVEQAFQTIARNALKQETEVELYNEFPEPIKLDKNDRAKASAESCSC

SEQ ID NO: 108 - DNA, 2240 bp, Homo sapiens
acttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatgataaaaaaaa

SEQ ID NO: 109 - protein, 184 aa, Homo sapiens [sequence omitted]

SEQ ID NO: 110 - DNA, 985 bp, Homo sapiens
cctgcctcctcagatctcgtttcttcggctacgaatctcgcgagaagtcaagttctcatgagttctcccaaaatccaccgctcttcctctttccctaagcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaagaaaaaaaaaaaaaaaaaaaaaaaa

SEQ ID NO: 111 - protein, 184 aa, Homo sapiens [sequence omitted]

SEQ ID NO: 112 - DNA, 736 bp, Homo sapiens
cctgcctcctcagatctcgtttcttcggctacgaatctcgcgagaagtcaagttctcatgagttctcccaaaatccaccgctcttcctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaagaaaaaaaaaaaaaaaaaaaaaaaa

SEQ ID NO: 113 - protein, 184 aa, Homo sapiens [sequence omitted]

SEQ ID NO: 114 - DNA, 834 bp, Homo sapiens
cctgcctcctcagatctcgtttcttcggctacgaatctcgcgagaagtcaagttctcatgagttctcccaaaatccaccgctcttcctctttccctaagcagcctgagggttgactggattggtgaggcccgtgtggctacttctgtggaagcagtgctgtagttactggaagataaaagggaaagcaagcccttggtgggggaaagtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaagaaaaaaaaaaaaaaaaaaaaaaaa

SEQ ID NO: 115 - protein, 184 aa, Homo sapiens [sequence omitted]

SEQ ID NO: 116 - DNA, 835 bp, Homo sapiens
gcctgaggtgagtgtttctcctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtcagtcggcctctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaagaaaaaaaaaaaaaaaaaaaaaaaa

SEQ ID NO: 117 - protein, 184 aa, Homo sapiens [sequence omitted]

SEQ ID NO: 118 - DNA, 933 bp, Homo sapiens
gcctgaggtgagtgtttctcctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtcagtcggcctctgagggttgactggattggtgaggcccgtgtggctacttctgtggaagcagtgctgtagttactggaagataaaagggaaagcaagcccttggtgggggaaagtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaagaaaaaaaaaaaaaaaaaaaaaaaa

SEQ ID NO: 119 - protein, 184 aa, Homo sapiens [sequence omitted]

SEQ ID NO: 120 - DNA, 916 bp, Homo sapiens
gcctgaggtgagtgtttctcctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccgggggttgactggattggtgaggcccgtgtggctacttctgtggaagcagtgctgtagttactggaagataaaagggaaagcaagcccttggtgggggaaagtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaagaaaaaaaaaaaaaaaaaaaaaaaa

SEQ ID NO: 121 - protein, 184 aa, Homo sapiens [sequence omitted]

SEQ ID NO: 122 - DNA, 818 bp, Homo sapiens
gcctgaggtgagtgtttctcctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaagaaaaaaaaaaaaaaaaaaaaaaaa

SEQ ID NO: 123 - protein, 146 aa, Homo sapiens
MHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLKKQKLMARE

SEQ ID NO: 124 - DNA, 695 bp, Homo sapiens
cctgcctcctcagatctcgtttcttcggctacgaatctcgcgagaagtcaagttctcatgagttctcccaaaatccaccgctcttcctctttccctaagcagcctgaggtgatctgtgaaaatggttcgctattcacttgacccggagaaccccacgaaataacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaagaaaaaaaaaaaaaaaaaaaaaaaa

SEQ ID NO: 125 - protein, 137 aa, Homo sapiens [sequence omitted]

SEQ ID NO: 126 - DNA, 4245 bp, Homo sapiens
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagaaggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcagcctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaaaaaaaaaaaaaaaaaaaaaaaaaaaaaaaaaaaaaa

SEQ ID NO: 127 - protein, 163 aa, Homo sapiens
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMVSWGLGIRLGETGQCCGEGPPTTGCNMGWRGMDSCFQPTPHTQHWPRGRLVECMG

SEQ ID NO: 128 - DNA, 4439 bp, Homo sapiens
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggtgagctggggtttggggatcaggcttggggagactggccagtgctgtggggaagggcctcccactactggttgcaatatgggctggagagggatggattcttgctttcagcctactccccacacccagcattggcctagggggcggcttgtggagtgtatgggctgagccttgctctgctcccccgcccccaggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagaaggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcagcctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaaaaaaaaaaaaaaaaaaaaaaaaaaaaaaaaaaaaaa

SEQ ID NO: 129 - protein, 169 aa, Homo sapiens
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMDMLASTGSGLCCSVAVQPWASSSTSLCLRTLICNMRVDRPYYSGLMRRLNVQNLLDCAHKS

SEQ ID NO: 130 - DNA, 934 bp, Homo sapiens
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaaaaaaaaaaaaaaaaaaaaaaaaaaaaaaaaaaaaaa

SEQ ID NO: 131 - protein, 87 aa, Homo sapiens
MSAHLQWMVVRNCSSFLIKRNKQTYSTEPNNLKARNSFRYNGLIHRKTVGVEPAADGKGVVVVIKRRSGEFCLVWARERPLSRVWEL

SEQ ID NO: 132 - DNA, 594 bp, Homo sapiens
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgagg

SEQ ID NO: 133 - protein, 69 aa, Homo sapiens
MSAHLQWMVVRNCSSFLIKRNKQTYSTEPNNLKARNSFRYNGLIHRKTVGVEPAADGKGVVVVIKRRSE

SEQ ID NO: 134 - DNA, 682 bp, Homo sapiens
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccgagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgt

SEQ ID NO: 135 - protein, 204 aa, Homo sapiens [sequence omitted]

SEQ ID NO: 136 - DNA, 755 bp, Homo sapiens
ctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaa

SEQ ID NO: 137 - protein, 249 aa, Homo sapiens
MKLNISFPATGCQKLIEVDDERKLRTFYEKRMATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRRIALKKQRTKKNKEEAAEYAKLLAKRMKEAKEKRQEQIAKRRRLSSLRASTSKSESSQK

SEQ ID NO: 138 - DNA, 829 bp, Homo sapiens
cctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctg

SEQ ID NO: 139 - protein, 1016 aa, Homo sapiens
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 140 - DNA, 4110 bp, Homo sapiens
gcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggaagtgtaaaaaaaaaaaaaaaaaa

SEQ ID NO: 141 - protein, 1034 aa, Homo sapiens
MAAATGAVAASAASGQAEGKKITDLRVIDLKSELKRRNLDITGVKTVLISRLKQAIEEEGGDPDNIELTVSTDTPNKKPTKGKGKKHEADELSGDASVEDDAFIKDCELENQEAHEQDGNDELKDSEEFGENEEENVHSKELLSAEENKRAHELIEAEGIEDIEKEDIESQEIEAQEGEDDTFLTAQDGEEEENEKDIAGSGDGTQEVSKPLPSEGSLAEADHTAHEEMEAHTTVKEAEDDNISVTIQAEDAITLDFDGDDLLETGKNVKITDSEASKPKDGQDAIAQSPEKESKDYEMNANHKDGKKEDCVKGDPVEKEARESSKKAESGDKEKDTLKKGPSSTGASGQAKSSSKESKDSKTSSKDDKGSTSSTSGSSGSSTKNIWVSGLSSNTKAADLKNLFGKYGKVLSAKVVTNARSPGAKCYGIVTMSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 142 - DNA, 4164 bp, Homo sapiens
gcggccgccgaggcctgggtggaagttggcgctgctgccgccgccctgcagcccactcgctgcctcggcagcgcgctgctcttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactcaagcaggctattgaagaggaaggaggcgatccagataatattgaattaactgtttcaactgatactccaaacaagaaaccaactaaaggcaaaggtaaaaaacatgaagcagatgagttgagtggagatgcttctgtggaagatgatgcttttatcaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggaaattgaagctcaagaaggtgaagatgatacctttctaacagcccaagatggtgaggaagaagaaaatgagaaagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagagctcttcaaaggaatctaaagacagcaagacatcatctaaagatgacaaaggaagtacaagtagtactagtggtagcagtggaagctcaactaaaaatatctgggttagtggactttcatctaataccaaagctgctgatttgaagaacctctttggcaaatatggaaaggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaaaaggtgatccctctaagaaagaaatgaagaaagaaaatgatgaaaagagtagttcaagaagttctggagataaaaaaaatacgagtgatagaagtagcaagacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagttccaagagtccaggacatatggtaatactagaccaaactaaaggagatcattgtagaccatcaagaagaggaagatatgagaaaattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggaacgtcgtaaggaagctgaacggattgctcgagaaagagaggaactcagaaggcaacaacagcagcttcgttatgaacaagaaaaaaggaattccttgaaacgcccacgtgatgtagatcataggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacagcactatcctgaggagcgacatgtggttgaacgccatggacgggacacaagcggaccaaggaaagagtggcatggtccaccctctcaagggcctagctatcatgatacgaggcgaatgggtgacggccgggcaggagcaggcatgataacccaacattcaagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggaagtgtaaaaaaaaaaaaaaaaaa

SEQ ID NO: 143 - protein, 227 aa, Homo sapiens
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLRVHLDIQVGEHANNYPEIAAKDKLTELQLRARQLLDQVEQIQKEQDYQRYREERFRLTSESTNQRVLWWSIAQTVILILTGIWQMRHLKSFFEAKKLV

SEQ ID NO: 144 - DNA, 1048 bp, Homo sapiens
ggcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccgcctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaaaaaaaaaaaaaaaaaaaaaaaaaaa

SEQ ID NO: 145 - protein, 689 aa, Homo sapiens
MADLEAVLADVSYLMAMEKSKATPAARASKKILLPEPSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 146 - DNA, 3478 bp, Homo sapiens
cgggcgcgcgggcggcggcggcggcggcgccccgactgcagtcccggcgggagcggagcgcgagccggggccgggcccgagccggcgccatggggcggcgccgcctgtgagcggcggcgagcggagccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatcctgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctgattaaaaaaaaaaaaaaaaaaaaaaaaaaaaaaaaaa

SEQ ID NO: 147 - protein, 444 aa, Homo sapiens
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 148 - DNA, 2510 bp, Homo sapiens
gcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaaaaaaaaaaaaaaaaaaaaaaaaa

SEQ ID NO: 149 - protein, 158 aa, Homo sapiens [sequence omitted]

SEQ ID NO: 150 - DNA, 2871 bp, Homo sapiens
gcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagacaaaaaaaaaaa

SEQ ID NO: 151 - protein, 158 aa, Homo sapiens [sequence omitted]

SEQ ID NO: 152 - DNA, 3128 bp, Homo sapiens
gcccgcgccagggtcctcggagctgctctggctgcgcgcggagcgggctccggagggaagtcccgagacaaagggaagcgccgccgccgccgccccgctcggtcctccacctgtccgctacgctcgccggggctgcggccgcccgaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagacaaaaaaaaaaa

SEQ ID NO: 153 - protein, 158 aa, Homo sapiens [sequence omitted]

SEQ ID NO: 154 - DNA, 2991 bp, Homo sapiens
aactcgcgggagcgtcaccgtcctgcgacgcttcagaggatccttaggcctcagtggtctttgacccccggccccaggacctgaccccaaggaaacctccgggacctgtggctggagaggtgaccgccaggcatccggggagcctttggagatctcggcttcctttttcccccgctgcttgccggcgtgtcctcgggtggacgcgggcagcccgaaggggagtttacagacgctccctcacatcggggacgcggctcctttaagggcggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagacaaaaaaaaaaa

SEQ ID NO: 155 - protein, 158 aa, Homo sapiens [sequence omitted]

SEQ ID NO: 156 - DNA, 2843 bp, Homo sapiens
aactcgcgggagcgtcaccgtcctgcgacgcttcagaggatccttaggcctcagtggtctttgacccccggccccaggacctgaccccaaggaaacctccgggacctgtggctggagagggactttgaacatgtcggggatcgccctcagcagactcgcccaggagaggaaagcatggaggaaagaccacccatttggtttcgtggctgtcccaacaaaaaatcccgatggcacgatgaacctcatgaactgggagtgcgccattccaggaaagaaagggactccgtgggaaggaggcttgtttaaactacggatgcttttcaaagatgattatccatcttcgccaccaaaatgtaaattcgaaccaccattatttcacccgaatgtgtacccttcggggacagtgtgcctgtccatcttagaggaggacaaggactggaggccagccatcacaatcaaacagatcctattaggaatacaggaacttctaaatgaaccaaatatccaagacccagctcaagcagaggcctacacgatttactgccaaaacagagtggagtacgagaaaagggtccgagcacaagccaagaagtttgcgccctcataagcagcgaccttgtggcatcgtcaaaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccaggtcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatctgcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtagagggccctgggcagcctgtgtctggaattcttcgtcctgaggccacctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccagggccctgggaaggggagctcggcaccctccaggtccgtgtgggactccagccgctgttggctgggaatcgaagttagaggtgacttccaaaggccccccgagccggcagtgccccccaccacccctccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccattaaagcatttgcacagacaaaaaaaaaaa

The invention claimed is:

1. A method for identifying a modulator of a biological system, the method comprising:
   (1) obtaining a first data set from a model for the biological system, wherein the model comprises cells associated with the biological system, and wherein the first data set represents global proteomic changes in the cells associated with the biological system;
   (2) obtaining a second data set from the model, wherein the second data set represents one or more functional activities or cellular responses of the cells associated with the biological system, and wherein said one or more functional activities or cellular responses of the cells comprises global enzymatic activity and/or an effect of the global enzyme activity on the enzyme metabolites or substrates in the cells associated with the biological system;
   (3) generating a computer implemented first causal relationship network model among the global proteomic changes and the one or more functional activities or cellular responses based solely on the first and second data sets using a programmed computing system including storage holding network model building code and a plurality of processors configured to execute the network model building code, wherein generating the computer-implemented first causal relationship network model comprises:
      (i) creating a list of network fragments, each network fragment including a plurality of variables connected by one or more relationships, and determining a probabilistic score associated with each network fragment based on the first data set and/or the second data set, wherein the variables correspond to the global proteomic changes, and the one or more functional activities or cellular responses of the cells associated with the biological system including the global enzymatic activity and/or effect of the global enzyme activity on the enzyme metabolites or substrates in the cells associated with the biological system;
      (ii) creating an ensemble of trial networks, each trial network including a different subset of the list of network fragments; and
      (iii) globally optimizing the ensemble of trial networks by evolving the trial networks in parallel using the plurality of processors, wherein one or more first processors in the plurality of processors used to evolve a first trial network are different from one or more second processors in the plurality of processors used to evolve a second trial network, and wherein evolving a trial network includes adding a network fragment from the list to the trial network or replacing a network fragment in the trial network with a network fragment from the list and determining whether the addition or replacement improves a total probabilistic score for the trial network;
   wherein the generation of the first causal relationship network model is not based on any known biological relationships other than the first and second data sets;

(4) generating a computer-implemented differential causal relationship network from the first causal relationship network model and a second computer-implemented causal relationship network model based on control cell data using a computing device by steps including:
  (i) for each relationship between two nodes in a selected one of the first causal relationship network model and the second causal relationship network model, determining if the other causal relationship network model includes a relationship between the same two nodes, and, where the other causal relationship network model includes a relationship between the same two nodes, determining if the relationship between the same two nodes in the other causal relationship network model has at least one significantly different parameter than that of the relationship in the selected causal relationship network model; and
  (ii) forming the differential causal relationship network by including the relationships in the selected causal relationship network model that are absent from the other causal relationship network model and including the relationships in the selected causal relationship network model that have at least one significantly different parameter in the other causal relationship network model; and
(5) identifying a causal relationship unique in the biological system from the differential causal relationship network, wherein at least one enzyme associated with the unique causal relationship is identified as a modulator of the biological system.

2. The method of claim 1, wherein the first data set further represents lipidomic data characterizing the cells associated with the biological system.

3. The method of claim 2, wherein the first causal relationship network model is generated among the global proteomic changes, lipidomic data, and the one or more functional activities or cellular responses of the cells, and wherein said one or more functional activities or cellular responses of the cells comprises global enzymatic activity and/or the effect of the global enzymatic activity on at least one enzyme metabolite or substrate.

4. The method of claim 1, wherein the first data set further represents one or more of lipidomic, metabolomic, transcriptomic, genomic and SNP data characterizing the cells associated with the biological system.

5. The method of claim 4, wherein the first causal relationship network model is generated among the global proteomic changes, the one or more of lipidomic, metabolomic, transcriptomic, genomic, and SNP data, and the one or more functional activities or cellular responses of the cells, wherein said one or more functional activities or cellular responses of the cells comprises global enzymatic activity and/or the effect of the global enzymatic activity on at least one enzyme metabolite or substrate and further comprises one or more of bioenergetics, cell proliferation, apoptosis, organellar function, cell migration, tube formation, chemotaxis, extracellular matrix degradation, sprouting, and a genotype-phenotype association actualized by functional models selected from ATP, ROS, OXPHOS, and Seahorse assays.

6. The method of claim 1, wherein the global enzyme activity comprises global kinase activity.

7. The method of claim 1, wherein the effect of the global enzyme activity on the enzyme metabolites or substrates is associated with the phospho proteome of the cells.

8. The method of claim 1, wherein the second data set representing one or more functional activities or cellular responses of the cells further comprises one or more of bioenergetics, cell proliferation, apoptosis, organellar function, cell migration, tube formation, chemotaxis, extracellular matrix degradation, sprouting, and a genotype-phenotype association actualized by functional models selected from ATP, ROS, OXPHOS, and Seahorse assays.

9. The method of claim 1, wherein the model of the biological system comprises an in vitro culture of cells associated with the biological system, optionally further comprising a matching in vitro culture of control cells.

10. The method of claim 9, wherein the in vitro culture of the cells is subject to an environmental perturbation, and the in vitro culture of the matching control cells includes identical cells not subject to the environmental perturbation.

11. The method of claim 10, wherein the environmental perturbation comprises one or more of contact with a bioactive agent, a change in culture condition, introduction of a genetic modification/mutation, and introduction of a vehicle that causes a genetic modification/mutation.

12. The method of claim 10, wherein the environmental perturbation comprises contacting the cells with an enzymatic activity inhibitor.

13. The method of claim 12, wherein the enzymatic activity inhibitor is a kinase inhibitor.

14. The method of claim 1, wherein step (3) is carried out by an artificial intelligence (AI)-based informatics platform that includes the programmed computing system.

15. The method of claim 14, wherein the AI-based informatics platform receives all data input from the first and second data sets without applying a statistical cut-off point.

16. The method of claim 1, wherein the generated first causal relationship network model is a first simulation causal relationship network model;
  wherein the optimized ensemble of trial networks based on the first data set and the second data set is a first consensus relationship network model; and
  wherein step (3) further comprises (iv) refining, by in silico simulation based on input data including some or all of the first data set and the second data set, the first causal relationship network model to a first simulation causal relationship network model to provide a confidence level of prediction for one or more causal relationships within the first causal relationship network model.

17. The method of claim 1, wherein the biological system is a disease process, the model comprises disease related cells, and the model represents a characteristic aspect of the disease process; and
  wherein the method comprises identifying, from the causal relationship network, a causal relationship unique in the disease process, wherein at least one enzyme associated with the unique causal relationship is identified as a modulator of the disease process.

18. The method of claim 17, wherein the disease process is cancer, diabetes, obesity, cardiovascular disease, age related macular degeneration, diabetic retinopathy, or inflammatory disease.

19. The method of claim 17, wherein the disease process comprises angiogenesis.

20. The method of claim 17, wherein the characteristic aspect of the disease process comprises a hypoxia condition, a hyperglycemic condition, a lactic acid rich culture condition, or combinations thereof.

21. The method of claim 1, wherein the method further comprises:

obtaining a first control data set representing global proteomic changes in control cells;

obtaining a second control data set representing one or more functional activities or cellular responses of the control cells, wherein said one or more functional activities or cellular responses of the control cells comprises global enzymatic activity and/or an effect of the global enzyme activity on the enzyme metabolites or substrates in the control cells; and generating the second causal relationship network model relating the global proteomic changes in the control cells and the functional activities or cellular responses of the control cells based solely on the first control data set and the second control data set using the programmed computing system, wherein generating the computer-implemented second causal relationship network model comprises:

(i) creating a second list of network fragments, each network fragment on the second list including a plurality of variables connected by one or more relationships, and determining a probabilistic score associated with each network fragment based on the first control data set and/or the second control data set, wherein the variables correspond to the global proteomic changes, and the one or more functional activities or cellular responses of the control cells including global enzymatic activity and/or effect of the global enzyme activity on the enzyme metabolites or substrates in the control cells;

(ii) creating a second ensemble of trial networks, each trial network in the second ensemble including a different subset of the second list of network fragments; and (iii) globally optimizing the second ensemble of trial networks by evolving the trial networks in parallel using the plurality of processors, wherein one or more first processors in the plurality of processors used to evolve a first trial network in the second ensemble of trial networks are different from one or more second processors in the plurality of processors used to evolve a second trial network in the second ensemble of trial networks, and wherein evolving a trial network includes adding a network fragment from the second list to the trial network or replacing a network fragment in the trial network with a network fragment from the second list and determining whether the addition or replacement improves a total probabilistic score for the trial network.

22. A method for identifying a modulator of a biological system, the method comprising:

(1) obtaining a first data set from a model for the biological system, wherein the model comprises cells associated with the biological system, and wherein the first data set represents global proteomic changes in the cells and one or more of lipidomic, metabolomic, transcriptomic, genomic, and SNP data characterizing the cells associated with the biological system;

(2) obtaining a second data set from the model, wherein the second data set represents one or more functional activities or cellular responses of the cells associated with the biological system, and wherein said one or more functional activities or cellular responses of the cells comprises global kinase activity and/or an effect of the global kinase activity on the kinase metabolites or substrates in the cells associated with the biological system;

(3) generating a computer implemented first causal relationship network model among the global proteomic changes, the one or more of lipidomic, metabolomic, transcriptomic, genomic, and SNP data, and the one or more functional activities or cellular responses based solely on the first and second data sets using a programmed computing system including storage holding network model building code and a plurality of processors configured to execute the network model building code, wherein generating the computer-implemented first causal relationship network model comprises:

(i) creating a list of network fragments, each network fragment including a plurality of variables connected by one or more relationships, and determining a probabilistic score associated with each network fragment based on the first data set and/or the second data set, wherein the variables correspond to the global proteomic changes in the cells, the one or more of lipidomic, metabolomic, transcriptomic, genomic, and SNP data characterizing the cells associated with the biological system, and the one or more functional activities or cellular responses of the cells associated with the biological system including the global kinase activity and/or an effect of the global kinase activity on the kinase metabolites or substrates in the cells associated with the biological system;

(ii) creating an ensemble of trial networks, each trial network including a different subset of the list of network fragments; and (iii) globally optimizing the ensemble of trial networks by evolving the trial networks in parallel using the plurality of processors, wherein one or more first processors in the plurality of processors used to evolve a first trial network are different from one or more second processors in the plurality of processors used to evolve a second trial network, and wherein evolving a trial network includes adding a network fragment from the list to the trial network or replacing a network fragment in the trial network with a network fragment from the list and determining whether the addition or replacement improves a total probabilistic score for the trial network;

wherein the generation of the causal relationship network is not based on any known biological relationships other than the first and second data sets;

(4) generating a computer-implemented differential causal relationship network from the first causal relationship network model and a second computer-implemented causal relationship network model based on control cell data using a computing device by steps including:

(i) for each relationship between two nodes in a selected one of the first causal relationship network model and the second causal relationship network model, determining if the other causal relationship network model includes a relationship between the same two nodes, and, where the other causal relationship network model includes a relationship between the same two nodes, determining if the relationship between the same two nodes in the other causal relationship network model has at least one significantly different parameter than that of the relationship in the selected causal relationship network model; and (ii) forming the differential causal relationship network by including the relationships in the selected causal relationship network model that are absent from the other causal relationship network model and including the relationships in the selected causal relationship network model that have at least one significantly different parameter in the other causal relationship network model; and (5) identifying a causal relationship unique in the biological system from the differential causal relationship network, wherein at least one kinase associated with the unique causal relationship is identified as a modulator of the biological system.

23. The method of claim 1 or claim 22, wherein the first causal relationship network model includes a Bayesian network of causal relationships including quantitative probabilistic directional information.

24. The method of claim 1 or claim 22, further comprising generating a graphical representation of the generated differential causal relationship network.

25. The method of claim 1 or claim 22, wherein the causal relationship unique in the biological system is identified from the generated graphical representation of the differential causal relationship network.

26. The method of claim 22, wherein the at least one significantly different parameter is a directionality of the relationship or a quantitative magnitude of the strength of the relationship.

27. The method of claim 22, wherein the method further comprises:
obtaining a first control data set representing global proteomic changes in control cells and one or more of lipidomic, metabolomic, transcriptomic, genomic, and SNP data characterizing the control cells;
obtaining a second control data set representing one or more functional activities or cellular responses of the control cells, wherein said one or more functional activities or cellular responses of the control cells comprises global kinase activity and/or an effect of the global kinase activity on the kinase metabolites or substrates in the control cells; and
generating the computer-implemented second causal relationship network model relating the global proteomic changes in the control cells and one or more of lipidomic, metabolomic, transcriptomic, genomic, and SNP data characterizing the control cells and the functional activities or cellular responses of the control cells based solely on the first control data set and the second control data set using the programmed computing system, wherein generating the computer-implemented second causal relationship network model comprises:

(i) creating a second list of network fragments, each network fragment in the second list including a plurality of variables connected by one or more relationships, and determining a probabilistic score associated with each network fragment in the second list based on the first control data set and/or the second control data set, wherein the variables correspond to the global proteomic changes in the control cells, the one or more of lipidomic, metabolomic, transcriptomic, genomic, and SNP data characterizing the control cells, and the one or more functional activities or cellular responses of the control cells including global kinase activity and/or an effect of the global kinase activity on the kinase metabolites or substrates in the control cells;

(ii) creating a second ensemble of trial networks, each trial network in the second ensemble including a different subset of the second list of network fragments; and (iii) globally optimizing the second ensemble of trial networks by evolving the trial networks in parallel using the plurality of processors, wherein one or more first processors in the plurality of processors used to evolve a first trial network in the second ensemble of trial networks are different from one or more second processors in the plurality of processors used to evolve a second trial network in the second ensemble of trial networks, and wherein evolving a trial network includes adding a network fragment from the second list to the trial network or replacing a network fragment in the trial network with a network fragment from the second list and determining whether the addition or replacement improves a total probabilistic score for the trial network.

\* \* \* \* \*